United States Patent 7,432,049 (COMPOSITIONS AND METHODS RELATING TO OSTEOARTHRITIS) - sequence listing, part 3

SEQ ID NO: 10499 - DNA, 400 bp, Homo sapiens
  misc_feature 3, 32, 58, 68, 78, 80, 298: n = A,T,C or G
cgngcgccctgcagcccgacactagtggatcnaaagaatttcggcacgagctttgctncagtcaacgntacaacggangnaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattgnattgccacacgggtcacattgcatgcatgtttgctgagctgaaggaaaagattgatcgccgttctggtaaaaagctggaagatggccctaaattcttgaagt

SEQ ID NO: 10500 - DNA, 400 bp, Homo sapiens
  misc_feature 4, 43, 64, 65, 66, 83, 167, 219, 220, 350, 384: n = A,T,C or G
gcgngcgcctgcaggcccgacactagtgggatccaaagaattnggcacgagtatttgtatttgnnntagtattgtgaagttgngttaaatagtactagctagaaatacaaatttctggttatcatttctcttccctgtggcacttgacattttaattgtcttaaagnttttgaagtacatcttctggccccttgagtactgccagaggcaaaagatggnngtttcttattcattccacttttgtctcctgggatcccttctgtagcctaaagtatggctgggaaatggacttgagaagattggcttgaattagatcataatcatgtgtgatcccatcatgaattcattgnaatttgtgttgcatgtaaggcaatctttcctgtngtaaatcttccttttt

SEQ ID NO: 10501 - DNA, 400 bp, Homo sapiens
  misc_feature 24, 39, 42, 90, 105, 118, 194, 256, 281, 327, 343, 366, 370: n = A,T,C or G
acactagtggatccaaagaattcngcacgagctcgtgcnganttcggcacgagcttttctgtacctatattttttgaagtggaatatganacacatatcatatanaaaactcatttanactgttgaaaattagaaaagtgtaatgcctttagaatatgtcctgtagaaagaagcagaatggaagctcagtgaanttcacaagtgaacaaagcacatttccccatctctcaatgtgcttaaagtgaggcatgatggnttgattttaggcattgttttttgtngttatgactgcgtaaattgctttaaaggaagatattgtgaggattngtttctcagaggattngatgaacgatgatgaagcgtggngtgnactgatgctacgctatgattctgggggctc

SEQ ID NO: 10502 - DNA, 117 bp, Homo sapiens
  misc_feature 3, 18, 32, 101: n = A,T,C or G
tgngggccggacactagnggtatccaaagaanttcggcacgagccttaggattatagtattacatgccataaaatactatgctttattggtcccatgtttngggcaattttaaagag

SEQ ID NO: 10503 - DNA, 388 bp, Homo sapiens
  misc_feature 13, 14, 28, 41, 43, 97, 158, 180, 195, 218, 255, 261, 271,317, 340: n = A,T,C or G
atccaaaaaattnngcacgaggcttggngcttatgctgacngngatgacgatgacaatgatgtttccgaaaaactagcacattccaaagagacaaanggaaaccagtcaactgatattgatagtacattggccaacttcctagcggagatcgatgccntaacagctcctcagcctgcagntcctgtaggagcttntgctccacctccaactccacctngaccagagccaaaggaagcagcaacatctaccctttnttcttntacttcaaanggaacagactccacccaaacatctggttggcaatatgatactcagngttcactggcaggaggtaaactngatcctttgatttttaaagaaaagtaaaatccttaaagggattctagg

SEQ ID NO: 10504 - DNA, 349 bp, Homo sapiens
  misc_feature 9, 22, 47, 56, 116, 130, 143, 244, 291, 333: n = A,T,C or G
gacactagnggatccaaagaanttcggcacgagcttggccctggggncttccgagngagctggtttaatactctgagaatgagcagggagatccagagaatgaatccctgaccgcntcacctaaactgtnttccaaacatganacaaagctgactgttcacactgattgcccagcacataccgtcttgccagtttcttcttttctcccagtctcctgttcatccattctgttctcccttggggngggaatctatgatggaggttactggggaaacagctcagcagattttnggagaccaaaccaaaggtctcactaggaaatttatctgtttnaaaacattgcttcctt

SEQ ID NO: 10505 - DNA, 172 bp, Homo sapiens
  misc_feature 7, 12, 40, 48, 50, 51, 111, 124: n = A,T,C or G
cccgacnctagnggatccaaaaaatttggcacgaggtaanctttaagncnncttattgaggattgacaccagctgatgattcctatattggtatttaaaattccagaaagncaaagctcaggcngaatagtaaaagaaaatgaaataatatgaagtcccagagaggaggaag

SEQ ID NO: 10506 - DNA, 141 bp, Homo sapiens
  misc_feature 10, 34, 37, 58, 67: n = A,T,C or G
acgagggcangcacctgtagtcccagctactcgngangctgaggcaggagaatggcgngaacccggnaggcagaggttgccgtgagctgagatcacaccactgcactccagcctgggtgacagagcgagactccatctgat

SEQ ID NO: 10507 - DNA, 315 bp, Homo sapiens
  misc_feature 17, 55, 70, 150: n = A,T,C or G
aaaacctggattttcgngcgcctgcaggtcgacactagtggatccaaagaattcngcacgagcggccgcnaaggtggcaagaagaagccactgaaacagcccaagaagcaggccaaggagatggacgaggaagataaggctttcaagcanaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctatt

SEQ ID NO: 10508 - DNA, 373 bp, Homo sapiens
  misc_feature 3, 18, 28, 59, 86, 126, 129, 156, 172, 235, 243, 268, 309: n = A,T,C or G
tgnaaaaagccggagttngtgcgcctgnaggtccacactagtggatccaaagaattcgntacgagtttcaagaccctcgagtcttncatccagggcctccggataatgtgaagctgagtgagcctncgncatccagcatgacaaactgtggccgancgcagctgtgccgtgncacgatggcgaggaagccagccccaaggaaacactgaaaacacatatcacgccaatgccgcgngggtttgnttgaatataaaattggtgaaagtgntggtttttttaaggcagtaatttttttgtttgtttttttgngatttcattccattcttgaccaaagcttctctttaagtagtttattatggaaaattggcacact

SEQ ID NO: 10509 - DNA, 102 bp, Homo sapiens
  misc_feature 14, 18, 34, 36, 63, 65, 78, 90: n = A,T,C or G
tgaaggcccgacantagnggatccaaaaaatttngnacgagctgacttctgttaatatcattngnacaattacatggntgtaaaataaanttttaaacctga

SEQ ID NO: 10510 - DNA, 183 bp, Homo sapiens
  misc_feature 11, 15, 31, 56, 98, 113, 130, 155, 159, 167: n = A,T,C or G
aggatcgacantagnggatccaaaaaattcngcacgagctcgtgccgaattcggcncgaaaaggaagggagggagggagggagggatatcacactgtntcctataaatatgtncaattattatatgtttnttaaaaataataaaagcagccaggngctntggctgancccaggagtttgagag

SEQ ID NO: 10511 - DNA, 400 bp, Homo sapiens
  misc_feature 10, 14, 63, 64, 67, 82, 177, 219, 220, 307: n = A,T,C or G
gtgggcctgnaganccccactagtggatccaaagaattctttacgagttttcaggttttgttnntgnccaacttcttacatnttaatctgactaatgactaagaaagagaggacagagctaaaggattggagaattcaatgttaaaaataaagaaatttattatcttgttaaaaggnaacacaggtctgccaaagtggacataataagaggccaactgnntaaagaatggctctcctgggaagtgcaccactcagattctcagtttctggtcctcaaagggctcatcctaattttaagggtggaggntccatgagaactaaacagcctaggacttcgcaccataatcaaaagcaggtcagagtaatggatggggacatttaaacaggactggccacatgc

SEQ ID NO: 10512 - DNA, 263 bp, Homo sapiens
  misc_feature 8, 14, 40, 89, 128, 204: n = A,T,C or G
gcgcctgnaggtcnacactagtggatccaaagaattcggnacgaggggaggtggaaatgatgagcagtagcatcatttctccctgttgngttttagccagtttgccagcaagcgcatcctagcagggnccccgagcagcaggttgtgtggatgaagggacaggcacttgcatccagctgatctaggtcacacctggctcttggntgccatgtgggttattaacagcttccagtggaagtcgcaataaacagtttttggtaaat

SEQ ID NO: 10513 - DNA, 158 bp, Homo sapiens
  misc_feature 21, 35, 38, 53, 72, 128: n = A,T,C or G
gctagtggatccaaagaattntttacgagagtcanggnagggggggaccggcngcaaacatgagcaactgcngatctacaaagacaagtaagtctcagagtaggaatttgcccggtactgcttgccantccctgacaaaacagagttctagactcagt

SEQ ID NO: 10514 - DNA, 129 bp, Homo sapiens
  misc_feature 3, 11, 80, 111, 118, 121: n = A,T,C or G
cgngcgcctgnaggtcgacactagtggatccaaagaattcggcacgagcccgcaaaggcaagataaatccttgttttgtnttcacccatgtaataacaggtgtttattgtnttgttcncantgaaaacc

SEQ ID NO: 10515 - DNA, 367 bp, Homo sapiens
  misc_feature 5, 22, 39, 52, 70, 123, 188, 219, 231, 278, 299, 361: n = A,T,C or G
gcgcntgcaggtcgacactagnggatccaaagtattcgncacgagctttggnagtgttaacacaaaaggngtctgatcttcatacaagcaatctttgctcacatacatcaaaatggaatgacncaaggaaagaaccattttgcaaaaggaaacaagacaagctgccgtcagctagatacgtttcgatngttcaggaaagtctgtacaggaactttgatnggcatcctgctngtctaccttctttcctactttaaaggggtagctctgatcattgttgncagggttttctgacccctcanatctggtctttgcctatcatgtctgatgtaggcacttggttcgattaccttgatttgcaggngaattg

SEQ ID NO: 10516 - DNA, 120 bp, Homo sapiens
  misc_feature 1, 14, 72, 82, 99, 108: n = A,T,C or G
ntccaaagaattcngcacgaggaatggctcccgcaaagaagggtggcgagaagaaaaagggccgttctgccntcaacgaagnggtaacccgagaatacnccatcaacnttcacaagcgca

SEQ ID NO: 10517 - DNA, 100 bp, Homo sapiens
  misc_feature 4, 21, 48: n = A,T,C or G
tagnggatccaaagaattctngcacgagcttaacctttttacaacctnttcccctttccccaggggtcctgtcctccactccagatcattcctttagttt

SEQ ID NO: 10518 - DNA, 146 bp, Homo sapiens
  misc_feature 8, 22, 116, 117: n = A,T,C or G
gcgcctgnaggtcgacactagnggatccaaagaatttggcacgagctcaagtaaaactcagttattacggtagagctggaacactttactgtttcgatgctaataatgcacccggnncctcaattcaactgctacaaataaatgtc

SEQ ID NO: 10519 - DNA, 397 bp, Homo sapiens
  misc_feature 4, 18, 69, 171, 174, 243, 344: n = A,T,C or G
tcgngcgcctgcaggtcnacactagtggatccaaagaattcggcacgaggctgtacaggggatcgaggncccaagtttggggttgaaagaaggttgacaggtggaggttgttagtgggaggatgctaactgaaaatgctttataaactacatgccttttccaagctgttgnggntcttctgtccagcctgccaccccttgactgtgtgtaaggtgattcttctgaccagtctactgctgcggnactctctgcgctgtatgtaagcctccagtaaaaccccgtgttttgtttgctggctctgggtcttgtttttggcctcttgaacttggtgccattccccttgnagtcaataggggtccggcacaagaacctgcactttaccaaccccagaatttta

SEQ ID NO: 10520 - DNA, 400 bp, Homo sapiens
  misc_feature 3, 17, 56, 72, 76, 126, 176, 248, 361: n = A,T,C or G
cgngcgcctgcaggtcnacactagtggatccaaagaattcggcacgaggctacgtngcctcctacctgctgnctgncctagggggcatctcctcccccagcgccaaggacatcaagaagatcttgnacagcgtgggtatcgaggcggacgacgaccggctcaacaaggttatcagngagctgaatggaaaaaacattgaagacgtcattgcccagggtattggcaagcttgccagtgtacctgctggnggggctgtagccgtctctgctgccccaggctctgcagcccctgctgctggttctgcccctgctgcacctgaggagaagaaagatgagaagaagggaggagtctgaagagtcangatgatgacatggggatttgggccttttttgattaaaat

SEQ ID NO: 10521 - DNA, 397 bp, Homo sapiens
  misc_feature 3, 14, 30, 58, 75, 77, 78, 79, 137, 188, 255, 296: n = A,T,C or G
ganaaaagccgganttttgtgcgcctgagngccccactagtggatccaaagaattcgnacgagattaaagcctancnnncaatgtaatggtatttggaggtagggccttcggtaagtaattaggtcatgagggtggnttcctcatgaatgggataaatacacttataaaaatagacatgagagagttngcttcctctttctctgctcattaccttgtggggatttcaaggagatgacaatcatctgcaaatcagngaccaagccctcaccagacaccagatctgctggcacctggntcctgggacttcccagcctccagaactgtgggaaataaaagtttgttgttaaggtcacctagtctatggtatatttgttatagcagcctgaactgacaaga

SEQ ID NO: 10522 - DNA, 400 bp, Homo sapiens
  misc_feature 41, 59, 84, 88, 91, 103, 168, 228, 335: n = A,T,C or G
cgtgcgcctgcaggtcgacactagtggatccaaagaattcngcacgaggatgaagcggngatacccccagcacgaggcttctgntgcncanactcaggcgctncctcccctggtggcagtgagctggggcctgctcagcacccccggccccaggatgtgcctgctggngcctgagagagcagcagccaggatgatttgagacaacatttagataaatctttggaaganaacagtaggttaaaatcgcttttgttgagtatgaaaaaggaagtgaagagtgcagacactgcagccacgttaaatttgcagatcgctggacttcaaacaagtgtgangaggctgtgtggcgagattgtggaacttgaagcagcacctggagcactacgacaagatccaggag

SEQ ID NO: 10523 - DNA, 320 bp, Homo sapiens
  misc_feature 3, 17, 33, 44, 137, 154, 198, 201, 222, 244, 250, 270, 296,302: n = A,T,C or G
tgnaggtcgacactagnggatccaaagaattcngcacgaggaanaacttatggcatattttcacccccacaaaagtcagttaaatattgggacactaaccatccaggtcaagaaaagtcacatgccatagccatggnattgcacatcattcatnttgcattctttgagaataagaagatcagtaaatagttcaaaagnggnaagctttgtccaggcctgtgngtgaacccaatgttttgtttanaaatanaacaagtaagttcattgctntagcataacacaaaatttgcataagngggggncagcaaatccttgaatgc

SEQ ID NO: 10524 - DNA, 174 bp, Homo sapiens
  misc_feature 11, 43, 47, 52, 95, 101, 110, 154, 168: n = A,T,C or G
ccgacactagnggatccaaaaaatttggcacgagttttgctgngcgnaaccnctttggtttaattagatcccatttgtaaattttggcttttgtngccatngcttttgtngtttcagtaatgaagtctttgcccatgcctatgtcctgaagggnattgcctaggtttncttcta

SEQ ID NO: 10525 - DNA, 103 bp, Homo sapiens
  misc_feature 6, 10, 65, 80, 95: n = A,T,C or G
cgacantagnggatccaaaaaattttgcacgagcaggacccgagcctccagcctgagcctagctnagcagcccaaggacnatggtgaggggaggnggggccag

SEQ ID NO: 10526 - DNA, 205 bp, Homo sapiens
  misc_feature 4, 8, 36, 126, 157: n = A,T,C or G
ctgnaggnccccactagtggcatccaaagaattcgncacgaggcttattctcacaagggccaagagcttgaaatgaagaaaaacagccttcaagttcctctttaagacagttttcataattatttntgacatcttcatgaacaatttaccttgtatnccccttaaacagttcattatgcctttagtctcatctttcacctttgtt

SEQ ID NO: 10527 - DNA, 400 bp, Homo sapiens
  misc_feature 7, 23, 62, 70, 111, 280, 307: n = A,T,C or G
tgggggngcttgaaggccgagantaggggatccaaagaatttggcacgagaaaatatgtttnaccacctntgatttcatctgataaccaccacccccaaaatacacacacntagacacacacataaacacacacatatacacacacagacacacaaacacacacacacacatactcacacatagacacacacataaacatacagacacacatagacacacatataaacacacacagacacacacataaacactcacacagacacacacatagacacacantcacacacacacacaaacatgcacacngacacacacataaacactcacacatagacacacaaacataacactcacacatagacacacacataaacactcacacatagacacatacacaga

SEQ ID NO: 10528 - DNA, 397 bp, Homo sapiens
  misc_feature 11, 41, 90, 95, 102, 126, 134, 151, 171, 190, 219, 273, 279,298, 330, 359: n = A,T,C or G
cgtgcgcctgnaggtcgacactagtggatccaaagaattcngcacgagccggaccagaagaaggagctgactgacatcgctcaccgcatngaggnacctggnaagggcatcctggctgcagatgantccactgngagcattgccaagcggntgcagtccattggcaccganaacaccgaggagaaccggngcttctaccgccagctgctgctgacagcngacgaccgcgtgaacccctgcattgggggtgtcatcctcttccatgagacactntaccanaaggcggatgatgggcgtnccttcccccaagttatcaaatccaagggcggngttgtgggcatcaaggtagacaagggcgnggtccccctggcagggacaaatggcgagactaccaccc

SEQ ID NO: 10529 - DNA, 400 bp, Homo sapiens
  misc_feature 10, 14, 40, 93, 122, 125, 197, 252, 280, 308: n = A,T,C or G
gtgcgcctgnaggnccgacactagtggatccaaagaattnggcacgagttttaaagtcattaagaacatgtgaaaggtgttttttttttccantatgaactcatgcaagttaccaaaactgnganaacccttttttacttactgtaaagagtcattttcataaagatcaattcattgatttgttttttgtaaagctntcattcaatatatattataaattaatataaatttaagggaagctctatgtaaggngacttagagccaaactgtttaagctgtntcatcccaacaaagtatcctttcatgancggggcatgcaatagcttaagaattgctaggattaaattaaggaaagtaaagctactcagagcagcaggttccacaagcacaaactttacac

SEQ ID NO: 10530 - DNA, 828 bp, Homo sapiens
  misc_feature 11, 50, 81, 86, 114, 140, 148, 186, 198, 216, 242, 278, 320,351, 381, 384, 450, 461, 469, 473, 475, 479, 480, 481, 486,487, 491, 492, 493, 494, 495, 496, 497, 515, 517, 519, 534,537, 539, 541, 549, 557, 564, 565, 566, 570, 576: n = A,T,C or G
  misc_feature 582, 585, 588, 590, 591, 593, 594, 599, 605, 610, 614, 615,618, 619, 620, 621, 622, 623, 624, 625, 626, 627, 628, 629,630, 631, 632, 633, 634, 635, 636, 637, 638, 639, 640, 641,642, 643, 644, 645, 646, 647, 648, 649, 650, 651, 652: n = A,T,C or G
  misc_feature 653, 654, 655, 656, 657, 658, 659, 660, 661, 662, 663, 664,665, 666, 667, 668, 669, 670, 671, 672, 673, 674, 675, 676,677, 678, 679, 680, 681, 682, 683, 684, 685, 686, 687, 688,689, 691, 692, 693, 694, 695, 696, 697, 698, 699, 700: n = A,T,C or G
  misc_feature 701, 702, 703, 704, 705, 706, 707, 708, 709, 710, 711, 712,713, 714, 715, 716, 717, 718, 719, 720, 721, 722, 723, 724,725, 726, 727, 728, 729, 730, 731, 732, 733, 734, 735, 736,737, 738, 739, 740, 741, 742, 743, 744, 745, 746, 747: n = A,T,C or G
  misc_feature 748, 750, 751, 753, 755, 756, 757, 758, 759, 760, 761, 762,763, 764, 765, 766, 767, 768, 769, 770, 771, 772, 773, 774,775, 776, 777, 778, 779, 780, 781, 785, 786, 787, 788, 789,790, 791, 792, 793, 794, 795, 796, 797, 798, 799, 800: n = A,T,C or G
  misc_feature 801, 802, 803, 804, 807, 809, 810, 812, 813, 814, 815, 816,817, 818, 819, 820, 822, 824, 825, 827, 828: n = A,T,C or G
tcgacactagnggatccaaagaattcggcacgagctcaagtccttacctnttccggagatgtagcaaaacgcatggagggngtatngttcccagggacacttcaaagagctggnagttagtagcatgttgagccaggccngggtctgngtctcttttctctttctccttagccttctcatagcatnaactaatctatngggttcattattggaatnaacctggggctggatattttcaaatngtatctagggcagctgattttaacaataactactgngttcctggcaatagggggttcataaatagctatatccatgtnctggagtttttcttcaacatcaatgttcatnggaatgttactgatcatgcattgttgaggnggnctgaatgttctgacattaacagttttccatgaaaacgtttaattgggtttttaaatttatttattnaaaaagggatnccccaganattnanattnnnaaatnnaaannnnnnnccaccctgggggcctttngncntgggggaaagggganttngnanggaaaaanttaaaccnttggttnnntttnttggtnccaagnacnttngnnannaaaancctttnaaggngganngcnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnngnngngnnnnnnnnnnnnnnnnnnnnnnnnnnngggnnnnnnnnnnnnnnnnnnnnccncnncnnnnnnnnngngnnann

SEQ ID NO: 10531 - DNA, 104 bp, Homo sapiens
  misc_feature 5, 13, 39: n = A,T,C or G
aaaancctggttntcgcgcgcctgcaggccgacactagnggatccaaagaattcggcacgaggaagctttttgaattcggcacgaggtcatttcaaagttactt

SEQ ID NO: 10532 - DNA, 391 bp, Homo sapiens
  misc_feature 5, 16, 28, 87, 164, 192, 200: n = A,T,C or G
aaaanctggagctcgngcgcctgcaggncgacactagtggatccaaagaattcggcacgagaggggctctagggactgccaggctgnttcagccgggaaggccaaaatcaagagtgagatgtaggaaagttgtaaaatagaaaaagtggagttggtgaatcggntgttctttcctcacatttggatgattgncataaggnttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttc

SEQ ID NO: 10533 - DNA, 106 bp, Homo sapiens
  misc_feature 6, 8, 34, 58, 75: n = A,T,C or G
cctggntntcgcgcgcctgcaggccgacactagnggatccaaagaattcggcacgagngaacatgctcatggaangtccaccttcttctgattccttttttgtatt

SEQ ID NO: 10534 - DNA, 205 bp, Homo sapiens
  misc_feature 8, 22, 75, 106, 108, 126, 171, 189: n = A,T,C or G
gcgcctgnaggccgacactagnggatccaaagaattcggcacgaggcggagcgggctccggagggaagtcccganacaaagggaagcgccgccgccgccgccccgntnggtcctccacctgtccgntacgctcgccggggctgcggccgcccgagggactttgaacatgtnggggatcgccctcagcanactcgcccaggagagg

SEQ ID NO: 10535 - DNA, 400 bp, Homo sapiens
  misc_feature 11, 29, 45, 83, 85, 105, 233, 389, 395: n = A,T,C or G
aaaaacctggntttcgtgcgcctgcaggncgacactagtggatcnaaagaattcggcacgagcaacaacgtgaaggtggccgngngtgacatcccgccccgcggnctcaagatgtcctccaccttcatcgggaacagcacggccatccaggagctgttcaagcgcatctccgagcagttcacggccatgttccggcgcaaggccttcctgcactggtacacgggcgagggcantggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgnacttgnagtga

SEQ ID NO: 10536 - DNA, 400 bp, Homo sapiens
  misc_feature 11, 17, 97, 119, 131, 166, 169, 366: n = A,T,C or G
aaaaacctggntttcgngcgcctgcaggtcgacactagtggatccaaagaattcggcacgagggaaacaatagactagccaaaaaacttggaagccnagtctagggaatgacatgctgnagggaataaggnctttgaaaaggtcctacatgttcttaagattttanaanaacattcacatgtccagggctgtgcacacactcaggaaaaatgcaggcaggccccagtctcttaactctggctggccattaggctacacataatcaggaagtgaaggcaaaggctgagtagtaaactgcctggttgagtgttgaaggtatcctcccacccccacacacaatggacacagagccccttggctaggagnggatgatttattagttccaagtgttgaaggatat

SEQ ID NO: 10537 - DNA, 400 bp, Homo sapiens
  misc_feature 5, 31, 83, 113, 116, 120, 312: n = A,T,C or G
tgggnaaaaaacctggttttcgtgcgcctgnaggcccgacactagtggatccaaagaattcggcacgaggcttgggcaagctntctaaccatagtgggtaaatgatgccctgngtnttgncagtcaggcctgggctgctcctctctgggagggggagccccagggagctgggaaggcgatgatactgagacaaatgggagagctgcctgggagggccgggcagagccagttcccttgcacatttgccacaccagacccatgtctgtagggagcgccccagggctctggtgggttgttaattacagcaaacgnacattatctctggataattcgagcacgggattcttttgcctagggctgaaaagatgtgtctgctagccaagtagggggaaagcccgtg

SEQ ID NO: 10538 - DNA, 209 bp, Homo sapiens
  misc_feature 27, 65, 76, 118, 193, 206: n = A,T,C or G
tcgcgcgcctgcaggcccgacactagnggatccaaaaaattcggcacgaggacaaatcaggatgnggccagagaanacagaatggcgggggggcactcgaaagccagggtgaactganaaaaagatgagcagagagctgtcactgcttactcaaaaagctggcttggagttgaagggttaaattctccgtccntgtaaagggcagngag

SEQ ID NO: 10539 - DNA, 167 bp, Homo sapiens
  misc_feature 4, 14, 39, 57, 125, 162: n = A,T,C or G
tagnggatccaaanaattcggcacgagcaggagcagggntggacgggcctgaagganaccaggggccccaaggaccccaaggcgtgcccggcaccagcaaggacggccaggacggtgctcccggngagcctgggcctccccgaagcacagtggacggtcatnaagga

SEQ ID NO: 10540 - DNA, 181 bp, Homo sapiens
  misc_feature 10, 12, 38, 63, 79, 113, 158, 161: n = A,T,C or G
aaaccctggntntcgcgcgcctgcaggccgacactagnggatccaaagaattcggcacgaggngattatggggatggcngtaatgatgatgatgatttagtatgattcaccancaggttataagacttcagaatgtcacgaactggggaaaaaaaaangtntatttttttgtaattgtagg

SEQ ID NO: 10541 - DNA, 186 bp, Homo sapiens
  misc_feature 14, 16, 40, 109, 114, 145, 181: n = A,T,C or G
aaaacccctggtgntngcgcgcctgcaggccgacactagnggatccaaagaattcggcacgagcacaggctgagaactcgttcacctccaagcatttcatgaaaaagcngcttnttattaatcatacaaactctcaccatgatgngaagagtttcacaaatctttcaaaataaaaagtaangactt

SEQ ID NO: 10542 - DNA, 400 bp, Homo sapiens
  misc_feature 10, 14, 58, 60, 65, 86, 105, 111, 147, 188, 296, 327: n = A,T,C or G
gtgcgcctgnaggncgacactagtggatccaaagaattcggcacgagctcgtgcagantncggcncgagccaacactgccaacgtncagatgaccttcctacgcntgctgnccacggaaggctcccagaacatcacctaccactgcnagaacagcattgcctatctggacgaagcagctagcaacctnaagaaggccctgatcatccagggctccaatgacgtggagatccgggcagagggcaatagcaggttcacgtacactgccctgaaggatggctgcacgaaacataccggnaaggggggcaagactgttatcgagtaccggncacagaagacctcacgcctccccatcattgacattgcacccatggacataggagggcccggagcaggaattcg

SEQ ID NO: 10543 - DNA, 400 bp, Homo sapiens
  misc_feature 16, 41, 79, 84, 110, 123, 140, 390: n = A,T,C or G
tcgtgcgcctgcaggncgacactagtggatccaaagaattnggcacgaggtcagccaggtgccttcacctgctatttgnatgcnggccttgccagaactaccactggcantaaagtttttggngccctgaagggagctgnggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataaagaaagctcatgctgctatacgagagantccagtctat

SEQ ID NO: 10544 - DNA, 393 bp, Homo sapiens
  misc_feature 11, 29, 70, 73, 74, 76, 242, 266, 328: n = A,T,C or G
aaaaacctggntttcgtgcgcctgcaggncgacactagtggatccaaagaattcggcacgagctcgtgcnganngnggcgcgaggcattaacctatgatgtacggcacccttatagaatatacagctggtgctaaataagtatctgttgaatgaatgggtaaacaaattcaatgttacagatgaggagaaaaaaatctggttttgttaccttcattttctctttttctagcacatgccttgnccataggatagtcaggatgacagngggaagtgtcagaccagcctaaggttcaagttcatctctctgactgaaaaagagctgccggngatagagctctgctttgagcttggaataatgctggtgctttacatgtgtgttgctaagccccact

SEQ ID NO: 10545 - DNA, 400 bp, Homo sapiens
  misc_feature 2, 6, 106, 174, 342: n = A,T,C or G
tntcgngcgcctgcaggtcgacactagtggatccaaagaattcggcacgagatcccagctactcaggaggctgaggcatgagaatcgcttgaacctgggaggcacnaggttgcagtgagccgagatcgagccagtgcacttcagcgtggttgacagagcgaaactccatctcanaaaaaagaacaaacaaaagaaaacctaacacacaacaagaaggacttctttttgggaaaggaaagaaataaggaaggagaggaaagagatgcaccttttttttctggctgaggctatctgctgtcagggagaaggctttttgagtggaagggttggggctggatttancatgaactcctccccaagcttagccttgagtcttgatcagagtgatcacatagtcatt

SEQ ID NO: 10546 - DNA, 308 bp, Homo sapiens
  misc_feature 3, 17, 64, 66, 101, 179, 241: n = A,T,C or G
tgnaggccgacactagnggatccaaagaattcggcacgaggccgttcagtcgccaatatgcagntntttgtccgcgcccaggagctacacaccttcgaggngaccggccaggaaacggtcgcccagatcaaggctcatgtagcctcactggagggcattgccccggaagatcaagtcgngctcctggcaggcgcgcccctggaggatgaggccactctgggccagtgcgggggggaggccntgactaccctggaagtagcaggccgcatgcttggaggtaaagtccatggttccctggcccgtgctgg

SEQ ID NO: 10547 - DNA, 376 bp, Homo sapiens
  misc_feature 5, 9, 98, 103, 152, 224, 311, 314, 329: n = A,T,C or G
gacantagnggatccaaagaattcggcacgaggcagcgcggaggccgcacgatgcctggagttactgtaaaagacgtgaaccagcaggagttcgtcanagctntggcagccttcctcaaaaagtccgggaagctgaaagtccccgaatgggnggataccgtcaagctggccaagcacaaagagcttgctccctacgatgagaactggttctacacgcgagctgnttccacagcgcggcacctgtacctccggggtggcgcttggggttggcttccatgaccaagatctatgggggacgtcagaaaaacggngtnatgcccagccacttnagccgaggctccaagagtgtggcccgccgggtcctccaagccctgga

SEQ ID NO: 10548 - DNA, 400 bp, Homo sapiens
  misc_feature 17, 223, 237, 315, 349, 350, 371: n = A,T,C or G
aataagctggagctcgngcgcctgcaggtcgacactagtggatccaaagaattcggcacgagcagcccttgaggttttagaagaagaaaaccttgctgaaaatgctgacaaattgggcattatcttgagaaatgaactcatgaagctaccttctgatgttgtaactgccgtaagaggaaaaggattattaaacgctattgtcattaaagaaaccaaagattgngatgcttggaaggngtgtctacgacttcgagataatggacttctggccaagccaacccatggcgacattatcaggtttgcgcctccgctggngatcaaggaggatgagcttcgagagtccattgannttattaacaagaccatcttgnctttctgagggtagccagctgttttcagt

SEQ ID NO: 10549 - DNA, 137 bp, Homo sapiens
  misc_feature 9, 20, 31, 33, 70, 71, 73, 91, 114, 116, 127: n = A,T,C or G
aggtcgacnctagtggatcnaaagaattcgncncgagtaagcctctcctgcctatcgtatagagctgctnnangagtaaatgatacacggnttttttctgtataaaaataccgngnatcatttactntttctgctgt

SEQ ID NO: 10550 - DNA, 400 bp, Homo sapiens
  misc_feature 3, 5, 27, 74, 220, 269, 322, 336, 353, 365, 376, 397: n = A,T,C or G
tgnantctgtgtgaccctgcagtgcgncgactagtggatccaaagaattcggcacgaggccagctgaggactgnatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtganggaaatcatagaacctccaaagattcgcatcccaagacacctgaagcanacctatatccgcagagttggagaagctgtcaatctggttatacctttccaggnaaaaccaagaccanaattaacttggaagaangatggtgcaganattgataagantcaaataaacattcgcaactntga

SEQ ID NO: 10551 - DNA, 400 bp, Homo sapiens
  misc_feature 29, 100, 171, 224, 396: n = A,T,C or G
aataagctggagctcgtgcgcctgcaggncgacactagtggatccaaagaattcggcacgaggagctataacatgtacatcttccctgtacactggcagntcggccagctggaccagcaccccattgacgggtacctctcccacaccgagctggctccactgcgtgctccnctcatccccatggagcattgcaccacccgctttttcgagacctgtgacctggncaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatgggtttggntggt

SEQ ID NO: 10552 - DNA, 169 bp, Homo sapiens
  misc_feature 7, 23, 31, 40, 118: n = A,T,C or G
aaagccnggagctcgcgccgccntgcaggtngacactagnggatccaaagaattcggcacgagccattgccttattcatactagcatgctcatgaccaacacatacacgtcatagaanaaaataggggggcttctttctgatctctaggggagatctctttgactgctg

SEQ ID NO: 10553 - DNA, 154 bp, Homo sapiens
  misc_feature 3, 13, 35, 39, 64, 72, 82, 84, 89: n = A,T,C or G
aanaagctggagntcgcgcgcttgcaggtcgacantagnggatccaaagaattcggcacgagcnggcgtgcngtttcccggntntccgngcggccggggaaggtcagcgccgtaatggcgttcttggcgtcgggaccctacctgacccatcagc

SEQ ID NO: 10554 - DNA, 138 bp, Homo sapiens
  misc_feature 5, 9, 34, 40, 48, 63, 71, 88, 113: n = A,T,C or G
gacantagnggatccaaaaaattcggcacgaggntcgttntcagcctntggggcccaaatagngtccaggnggcctcctctgcctggnaccctcctgacggaagcttcaccantttccatgatggaccccagcccctc

SEQ ID NO: 10555 - DNA, 291 bp, Homo sapiens
  misc_feature 15, 20, 28, 33, 37, 40, 79, 103, 141, 164, 169, 213, 217,238, 255, 261, 274: n = A,T,C or G
aagctggagcttcgngcgcntgcaggtngacantagnggntccaaagaaattcggcacgagaaaaagtttgcctgcaanggtactgtaattgagcatccggantatggagaagtaattcagctacagggggaccaacgcangaacatatgccagttcctcgtanagatnggactggctaaggacgatcagctgaaggttcatgggttttaagngctnggggctcactgaagcttaagngaggatttccttgcaangagtanaatttcccttctntcccttgtcacaggttt

SEQ ID NO: 10556 - DNA, 175 bp, Homo sapiens
  misc_feature 14, 18, 118, 130, 136: n = A,T,C or G
ataagctgagctcntgcncctgccggtcgacactagtggaccaaagaattcggcacgaggctgtacataatggcagttttgtaaatgtgagataaccttgaatatgttgtggtttgtntacagagccatnagtatngttattttggccacttttttattcaaaataaataacata

SEQ ID NO: 10557 - DNA, 349 bp, Homo sapiens
  misc_feature 17, 44, 107, 129, 130, 150, 182, 232, 325: n = A,T,C or G
aataagctggaagctcntgcgccctgcaggtcgacactagtggntccaaagaattccggcacgagctgatatttttagtgctttcttcaaaatgattgctaacacgngtattatattttagtatcttgnngcattcacttgttaatctgnatttatgcttctgtatatgcagagttttttgntttttccaacacaatttaaaattctacttaaaaattacttgtttggattnctaagcagatttgggaattacggcattgaaaatactttgttgctttttatgtctcaataaagtctatgcatttttataatattggaccagtgnttgacctgccagaataaaatgatg

SEQ ID NO: 10558 - DNA, 400 bp, Homo sapiens
  misc_feature 8, 13, 39, 105, 170: n = A,T,C or G
tcgtgcgncctgnaggtccgacactagtggatccaaagnaattcggcacgagggaagaagagcccgaagaagaacctgaagagacagcagaagacacaacaggangacacagagcaagacgaagatgaagaaatggatgtgggaactgatgaagaagaagaaacagcaanaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttaggtgaattttttttaacattcctcatgaatgtaaatttgtac

SEQ ID NO: 10559 - DNA, 350 bp, Homo sapiens
  misc_feature 15, 18, 43, 83, 92, 113, 127, 140, 157, 180, 184, 231, 255,316, 322: n = A,T,C or G
aaaaaaaacctgganctngccgcgcttgcaggtggacactagnggatccaaagaaattcggcacgaggtttcaccatgttggncaggctggncccgaactcctgacctcaggngatccatccacctnggcctcccaaagngctgggatgacaggcgngagccaccgcgcccagccagccntgcntttttactatagaaataaagatgaaaaatctcaagtaatcccatcanctaaagatgattagagttaaaacntgttgggtttataattctttataaaatagccttttaaatccaactgatttggactagggtngggggngcttaggaaataaggagtaaataataag

SEQ ID NO: 10560 - DNA, 152 bp, Homo sapiens
  misc_feature 4, 32, 52, 97, 101, 112, 120: n = A,T,C or G
tagnggatccaaagaattcggcacgagcccgncgggaaggttttccagtttnttaatgcgaaatgcgagtcggctttcctttccaagaggaatcctnggcngataaactggnctgtcctntacagaaggaagcccaaaaggggacagtcgga

SEQ ID NO: 10561 - DNA, 168 bp, Homo sapiens
  misc_feature 6, 16, 32, 41, 81, 92, 98, 117, 167: n = A,T,C or G
aaaaancctggagctngcgcgccctgcaggtngacactagnggatccaaagaaattcggcacgagcaaaagcgacctcttntttagtccggngttacnaacagaagttctgagttgngctacaaaagtagttccatctttttggggtaattttcatgtttttaattng

SEQ ID NO: 10562 - DNA, 400 bp, Homo sapiens
  misc_feature 17, 73, 122, 178, 185, 248, 259, 325, 347: n = A,T,C or G
aataagctggagctcgngcgcctgcaggtccgacactagtggatccaaagaattcggcacgagggaaaccagntgaagaagatgagatttcggaggaattgaaagaaaaggccaagattgangatgagaaaaaggatgaagaaaaagaagaccccaaaggaccttcctgaattttggntaactgnttttaagaatgttgacttgctcagtgatatggttcaggaacacgatgaacctattctgaagcncttgaaagatnttaaagtgaagttctcagatgctggccagcctatgagttttgtcttagaatttcactttgaacccnatgaatattttacaaatgaagngctgacaaagacatacaggatgaggtcagaaccagatgattctgatccctttt

SEQ ID NO: 10563 - DNA, 400 bp, Homo sapiens
  misc_feature 9, 24, 43, 54, 55, 63, 69, 150, 162, 179, 324, 330: n = A,T,C or G
aaaagctgnagctcgcgcgcctgnggtcgacactagtggatcnaaagaattcgnncgagattnagccgncggttcggggcgacggactctccattccagaaccatggcccaatttgtccgtaaccttgtggagaagaccccggcgctggngaacgctgctgngacttactcgaagcctngattggccacattttggtactacgccaaggttgagctggttcctcccacccctgctgagatccctagagctattcagagcctgaaaaaaatagtcaatagtgctcagactggtagcttcaaacagctcacagttaaggaagctgngctgantggtttggtggccactgaggtgttgatgtggttttatgtcggagagattataggcaagcggggcatcatt

SEQ ID NO: 10564 - DNA, 398 bp, Homo sapiens
  misc_feature 94, 245, 307, 317, 374, 378: n = A,T,C or G
aaaagctggagctcgcgcgcctgcaggtcgacactagtggatccaaagaattcggcacgaggtacagcaagatgtcattaaatattgaatgctntattgggggaagacagatgaagagaatgcattttgagcatttcaaatcagtagtttgggcagtgccttttggggtccaatctttttggattggattctatttcatcttttgatgtgacttttcactagtttacaaaaaaaaggttggtggncaacaaaaaaagcaagtcatagcagttcagtgcctttgttggcagtttttaactttttttgngattcttttnggaaaatcatagcttacagatggtataactgtattatataatgggaattttctttangtgngggaaaacttgatctgaaag

SEQ ID NO: 10565 - DNA, 201 bp, Homo sapiens
  misc_feature 4, 9, 35, 56, 63, 100, 152, 167, 175: n = A,T,C or G
gacnctagnggatccaaagaattcggcacgaggancattctaaaatcagtcatganggttgtncttcctcatgaatatatatgaggatcactaaactgtncattttaaagcatagttatactttaaaagtatttcttaaaatatatgaagtncatactttaaaagtntatgtttnggggtatggggatatcacaataaagt

SEQ ID NO: 10566 - DNA, 212 bp, Homo sapiens
  misc_feature 21, 36, 40, 59, 68, 120, 135, 138: n = A,T,C or G
caaaaagctggagctcgcgcncctgcaggtcgacantagnggatccaaagaattcggcncgagaacancatcaagatagatggaattggaaggatgctaccaggagagtacttacatagngctcaggagtttctnttnttaaaatgtttactgctgaaagatgagcaggaccagggcgttataggcagagccctagccgagaaacctgctgg

SEQ ID NO: 10567 - DNA, 274 bp, Homo sapiens
  misc_feature 11, 17, 35, 39, 68, 91, 96, 159, 179, 194, 226, 258, 272: n = A,T,C or G
aaaaagctggngctcgngcgcctgcaggtcgacantagnggatccaaagaattcggcacgagcttggntttgtaaaccaaatgggggtctntgttntagccactcagcactgctgttttaggacaaaagctgtaggctgtagataatatgtaaagaagnggcctggactgggcaccgtngggggctcatgcctntaatcctaacactttgggaggctgaggcgcgnggatcacctaggcccaggagttcaagaccggnctgggcaacatagnga

SEQ ID NO: 10568 - DNA, 400 bp, Homo sapiens
  misc_feature 16, 24, 44, 194, 380, 397: n = A,T,C or G
aaaagctggagctggngcgcctgnaggtcgacactagtggatcnaaagaattcggacgagcagaagcgagatgacgaagggaacgtcatcgtttggaaagcgtggcaataagacgcacacgttgtgccgccggtgtggctctaaggcctaccaccttcagaagtcgacctgtggcaaatgtggctaccctgccnagcgcaagagaaagtataacctggagtgcctaggctaaaagacgaaataccaccggaactggtcgaatgaggcacctaaaaattgtataccgcagattcaggcatggattccgtggaaggaacaacacctaaacccaagagggcagctggtgcagcatccagttcatcttaagaatgtcaacgatnagtcatgcaataaatgntct

SEQ ID NO: 10569 - DNA, 316 bp, Homo sapiens
  misc_feature 67, 234, 302: n = A,T,C or G
aataagctggaagctcgtgcgcctggggtcgacactagtggatccaaagaattcggacgagccggangttcctggtccacaacgtcaaggagctggaagtgctgctgatgtgcaacaatatcttactgtgccgagatcgctcacaatgtttcctccaagaaccgcaaagccatcgtggaaagagctgcccaactggccatcagagtcaccaaccccaatgccaggctgcgcagngaagaaaatgagtaggcagctcatgtgcacgttttctgtttaaataaatgtaaaaactgccatctggnatcttccttccttg

SEQ ID NO: 10570 - DNA, 123 bp, Homo sapiens
  misc_feature 15, 50, 70, 75, 87: n = A,T,C or G
aaaaagctggagctngccgcgcctgcgggtcggacactaggggatccaangaattcggcacgagaaaganggatngatcagagcatngggcaatacagtttcattaactccttcccccgctcc

SEQ ID NO: 10571 - DNA, 128 bp, Homo sapiens
  misc_feature 1, 17, 26, 32, 35, 50, 59, 62, 65, 70, 100, 122: n = A,T,C or G
ntccaaagaattcggcncgagctcgngccganttnggcacgagcgggggnagccatggnggntgngtcanagaggacactgcagttgtccgggctagtanccttcgcttttggagtactccngggctg

SEQ ID NO: 10572 - DNA, 104 bp, Homo sapiens
  misc_feature 40, 70, 83: n = A,T,C or G
caaaaagctggagctcgcgcgcctgcaggtcgacactagnggatccaaagaaattcggcacgaggggatntgcagactacagnggccaacagagcacttatggc

SEQ ID NO: 10573 - DNA, 234 bp, Homo sapiens
  misc_feature 8, 13, 62, 81, 94, 120, 130, 160, 184, 191, 225: n = A,T,C or G
attacacnttaantgggcgctaggggttccaaagaattcggcccgagctaacttcaaaaagncaactgccaaaagagaganaagatgcctcctntaccatgacattaccatcaaagggtncaagctttanaaaggaatacctaaagtaatgaatgcttgnaaaagaaaatctatgctgtctgtncttgggngggaattcagtaaaaaagaattcctccttcacanttaataatg

SEQ ID NO: 10574 - DNA, 400 bp, Homo sapiens
  misc_feature 16, 57, 64, 119, 240, 245, 253, 393: n = A,T,C or G
aaaagctggagctcgngcgccctgcaggtcgacactagtggatccaaagaattcggngcgaggncttattaaaattaataaattattggtctttacgagacttggatacacttacagcngacatggaaatataattttaaaaaatttctctccaacctccttcaaattcagtcaccactgttatattaccttctccaggaaccctccagtggggaaggctgcgatattagatttccttgnatgcnaagttttngttgaaagctgtgctcagaggaggtgagaggagaggaaggagaaaactgcatcataactttacagaattgaatctagagtcttccccgaaaagcccagaaacttctctgcagtatctggcttgtccatctggtctaaggnggctgct

SEQ ID NO: 10575 - DNA, 329 bp, Homo sapiens
  misc_feature 8, 12, 52, 68, 73, 87, 119, 124, 130, 208, 223, 225, 258,287, 296: n = A,T,C or G
gcgcctgnaggncgacactagtggatccaaagaattcggcacgagcaccagngcccccactcctcctnctttntttgctgtttgcanctcacacgtggtgacctcacacacctctgccncttgngcctcncactcccatggctctgggcggtccagaaggagcaggccctgggcctccacctctgtgcagggcacagaaggctggggnggggggaagagtggnantcctccccaccctgccccaggcagcgccactgncccgctgtcttccctcctgattctaaaangtctaaagngcaatgccccctcccctcctttaccgaggacag

SEQ ID NO: 10576 - DNA, 338 bp, Homo sapiens
  misc_feature 15, 186, 268, 300, 316, 318: n = A,T,C or G
aaagctggagctcgngcgcctgcaggtcgacactagtggatccaaagaattcggacgagctgacaggcgcttagcgggcgactccctccccattgtccgagttatggagcgctccgaccagacagcgtctcattggccaaagatgggagggttccgcttaaagaccgcctcttactggccaggagnggacttggttagggctaccttctcattggttgcagccagaggcacttctgcccgggctgcctctcccccgctagggcctggngcctctggctggaggctccctcccttggccgncccaatagagcccggngntacttccactggccaggctt

SEQ ID NO: 10577 - DNA, 344 bp, Homo sapiens
  misc_feature 28, 111, 133, 151, 184, 213, 233: n = A,T,C or G
aataagctggagctcgtgcgcctgaggncgacactagtggatccaaagaattcggcacgagcagaaacatcggatttggggaacgcgtgtcaatcccttgtgccgcagggntgggcgggagagactgttctgntccttgtgtaacctgtgntgctgaaagactacctcgatcttgtcttgatgngtcaccggggcaactgcctgagggccgcngatgggggcaagggtggaancgggctccccattttataccaaaggtgctacatctatgtgatgggtgggggtggtgagggaatcactggtgctatagaaattgagatgcccccccaggccagcaaatgctc

SEQ ID NO: 10578 - DNA, 278 bp, Homo sapiens
  misc_feature 11, 39, 65, 67, 72, 81, 84, 114, 125, 128, 199, 224, 238: n = A,T,C or G
aaaaagctggngctcgcgcgcctgcaggtcgacactagnggatccaaagaattcggcacgagctntntgcanaggccgctntgnaggatcctcgtgtcgcgcgtgatgtgtggnggcacagccgngtnaaagtcacagggtcttttctgtcgttctagttccagggtcacccccgagaggacaacaggcatctggaagngctctctcgccactctgggggcttnactgtctctggctngtttccatcactggaaatcacttaaagaattgtaggggtt

SEQ ID NO: 10579 - DNA, 100 bp, Homo sapiens
  misc_feature 3, 17, 58, 74, 77, 89: n = A,T,C or G
tgnaggtggacactagnggatccaaagaattcggcacgagccgaaatgggcaagttcntgaaacctgggaaggnggngcttgtcctggntggacgctact

SEQ ID NO: 10580 - DNA, 398 bp, Homo sapiens
  misc_feature 5, 24, 34, 38, 81, 89, 96, 98, 104, 141, 164, 180, 197, 201,226, 303, 336, 360, 397: n = A,T,C or G
aaaanctggagctcgcgcgcctgnaggtcgacantagnggatccaaagaattcggcacgagctgggactcccacggggccntccttgcngtccaananagagtntcccggagtgggcgggggcagcggcgacaaagcgagngcggccacccccccgtccagcanacgtgtctggtccccncccagagtccacaaggngganatgggcttcggtggaggtggaggancaaactgaaggggcaggctactggggtggggtagcttttcgggaaagggaataaggagcacgatgcaagggcgctgnggcccccgggtgatctcccaccacacttactgncttcctttatctctggggacttgnatatattctgggaagggggaaccacagtttcaccatng

SEQ ID NO: 10581 - DNA, 209 bp, Homo sapiens
  misc_feature 9, 15, 36, 41, 45, 111, 114, 118, 157, 164, 191, 206: n = A,T,C or G
aacattaanctggangtctcgcgcgccctgcaggtngacantagnggatccaaagaattcggaacgaggtcacgcctggcccggagacgggccctggcccaggcaggccgnggngaanacaggagcccgcccacagcactctgaaatgctccagtcncaccttntaggccctaggcctggccaggctttgncccctggaaacctgngtg

SEQ ID NO: 10582 - DNA, 339 bp, Homo sapiens
  misc_feature 25, 140, 145, 156, 188, 262, 281, 301, 305: n = A,T,C or G
aataagctggagctcgtgcgcctgnaggtcgacactagtggatccaaagaattcggacgagcccgcgccccgcgtggggtcccatccggcccatcgtgcgctgccccacggttcggtaccacacgaaggtgcgcgccggncgcgncttcagcctgnaggagctcagggtggccggcattcacaagaanggtggcccaggaccatcggcatttctgtggatcccgaggaggcggaacaagtccacggagtccctgcagaccancgtgcagcgggctgaaggngtaccggttccaaactcatncttnttccccaggaagcccttggacccccaagaaggga

SEQ ID NO: 10583 - DNA, 214 bp, Homo sapiens
  misc_feature 18, 26, 137, 148, 163: n = A,T,C or G
aataagctggaagctcgngcgcctgnggtcgacactagtggatccaaagaattcggcacgaggggaactcttgacactgagccactaaaatatggactaattttttggacaaatcttcaaacggactgtgctactgnatttgtctcanagctaccaagtttgngcaataagtggaagggatgtcatccttcttcaataaatgctgaatgacatt

SEQ ID NO: 10584 - DNA, 317 bp, Homo sapiens
  misc_feature 13, 17, 95, 124, 240: n = A,T,C or G
aataagctggagntcgngcgcctgcaggtcgacactagtggatccaaagaattcggcacgagctcggccgggctctaggcgccatggctccccgnggtaggaagcgtaaggctgaggccgcggnggtcgccgtagccgagaagcgagagaagctggcgaacggcggggagggaatggaggaggcgaccgttgttatcgagcattgcactagctgacgcgtctatgggcgcaacgccgcgnccctgagccaggcgctgcgcctggaggccccagagcttccagtaaaggtgaacccgacgaaacccccggagggccag

SEQ ID NO: 10585 - DNA, 302 bp, Homo sapiens
  misc_feature 12, 24, 63, 125, 170, 180, 286: n = A,T,C or G
ataagctggagntcgtgcgcctgnaggtcgacactagtggatccaaagaattcggcacgaganaaacactgactttaatacggttttactaagtttcaaccttctaattaggtaggcctctaggnattctgcagatcactgctggtcttgatagccattaatatatgttngaattatgtnatttttcaactaaatcgcagttggaaaaaaacatatttaatattatgcccttggatctgttactgcatcactagcacttgtgatgcaatagaacacttcgcctgtnctgaaagggccaagag

SEQ ID NO: 10586 - DNA, 329 bp, Homo sapiens
  misc_feature 16, 24, 34, 38, 112, 125, 158, 221, 227, 231, 256, 265, 289,306: n = A,T,C or G
aaaagctggagctcgngcgcctgnaggtggacantagnggatccaaagaattcggcacgagtcaaaacttccctggaggagccttgaaacttagattataaactattttagngagttataaaaangtccatgaaacccactaatgatatgaaatcacnctaaggggcaggggggccaaatttctgatgcatttttcagaggaggattattaaattattttngatatngaangtaatattaaattccatgtaaaatngggatgtancattttatatggaataataatatnggatagaaaatagaaangctaaatatggtttatgaatatt

SEQ ID NO: 10587 - DNA, 151 bp, Homo sapiens
  misc_feature 2, 11, 35, 36, 53, 62, 65, 104: n = A,T,C or G
tngacactagnggatccaaagaattcggcacgagnnatgaacgacaccgtaantatccgcantanaaagttcatgaccaaccgactacttcagaggaaacaaanggtcattgatgtccttcaccccgggaaggcgacagtgcctaagacag

SEQ ID NO: 10588 - DNA, 100 bp, Homo sapiens
  misc_feature 3, 5, 28, 39, 67, 70, 94: n = A,T,C or G
tanantggagtctgcgtgcccttgcagngggacactagnggatccaaagaattcggcacgagcttanttnaacaaacctttctgggaagctttnccctgt

SEQ ID NO: 10589 - DNA, 400 bp, Homo sapiens
  misc_feature 3, 30, 39, 75, 111, 124, 145, 150, 160, 239, 252, 307, 321,335, 353, 379, 387: n = A,T,C or G
aanaagctggagctcgcgcgcctgcaggtngacactagnggatccaaagaattcggcacgaggccctgccccgtnggactgcccccagaaagcctcctgccccctgccggngaagtccttcagngagcccctccccagccagccnttccntggccccgcnggatgtataaatgtaaaaatgaaggaattacattttatatgtgagcgagcaagccggcaagcgagcacagtattatttntccatcccctccntgcctgctccttggcacccccatgctgccttcagggagacaggcagggagggctnggggctgcacctcntaccctcccaccanaacgcaccccactggganagctgggggggcagccttcccctccntgtataanacactttgccaag

SEQ ID NO: 10590 - DNA, 217 bp, Homo sapiens
  misc_feature 16, 72, 217: n = A,T,C or G
aaaagctggagctcgngcgcctgcaggtcgacactagtggatccaaagaattcggcacgagctcgtgccganttcggcacgaggaaaatcaggagagtccggctatggaagtcacaggaagaatagattgtttcaggaaggagcttgtgctgaacagtgtcagacaccgctgagaggttaagcaaaataatccacacaaaggaagtattatcttaan

SEQ ID NO: 10591 - DNA, 400 bp, Homo sapiens
  misc_feature 16, 24, 70, 71, 76, 272, 341, 372: n = A,T,C or G
aaaagctggagctcgngcgcctgnaggtcgacactagtggatccaaagaattcggacgagctcgtgccgnnttcgncacgagggaaagagaggaggaagaagccatgagcccccccaacgtatgtgtttcacttaagctaagtgctaatgcactgacattggcagcaggagtggtggccctgccaaccttgtggggtttctaaaagggagagttggcataaggggaattcagatctagagaaggatgcaaataactttacagctagcattgnggctactcctgggcatttgggttatttataggttcagaactggcctgaaaggcattaagaaaatgactnaatggcacctcctcagcctgaagcagggctngcttcttcacctggagagaggtctggac

SEQ ID NO: 10592 - DNA, 340 bp, Homo sapiens
  misc_feature 14, 18, 93, 195, 203, 250, 253, 307, 338: n = A,T,C or G
aaataagctggagntcgngcgcctgcggtcgacactagtggatccaaagaattcggcacgagggaatattaaaattcttctatattggctggnaaattgccatggccctgagccactgagtatgttcattgccacccctgtccctcccctgggcacccctcactttccctgatcctgcaattaaagggttaatgngtggcatntggaagggactcccaggaccctgtgcccagcttccatgctgactganggntaaataatgtgattgtctcctcaaaactcgtgccgaattcggcacgaggtaagnacagagaagccatcacctcagatggcagctntt

SEQ ID NO: 10593 - DNA, 398 bp, Homo sapiens
  misc_feature 2, 19, 58, 81, 85, 111, 126, 146, 167, 171, 253, 263, 346,361, 394: n = A,T,C or G
cntgcaggtcgacactagnggatccaaagaattcggcacgagatttcatgtccaagancccaaaagcaaatgcaacaaaancaangataaatagctgggtcttaattaaantaaagagcttttgcntggcaaaaggaacagtcagntgagtaaacagacaacccgcngagngggaaaaagtcttcacaatctacatatctgacaaaggattaataccagaatctacaatgaactaaacaaattagtaagaaangatcaaacantcccatcaaaaagggggccagggacattaatagacaattctcaaaagaatatatacaaatggccaaaaaacatatgaaaaaangctcaacatcactantaatcagggaaatgcaaatcaaaactacaatgngata

SEQ ID NO: 10594 - DNA, 400 bp, Homo sapiens
  misc_feature 16, 24, 44, 98, 109, 116, 199, 341, 376, 391: n = A,T,C or G
ataagctggagctcgngcgcctgnaggtcgacactagtggatcnaaagaattcggcacgagaggagatcgagatcaccttcagctactgggatggctntgggcaccggnggacagncaagatgagaaagggcaacaccatgcagcagttcctgcagaaggcgctcgagatccttcggaaagacttcagtgagctgaggnccgcaggggtggagcagctcatgtacatcaaggaggacttgatcatccctcaccatcacagcttctacgacttcatcgacaccaaggcacgggggaaggagtggaccactcttcaactttgatgttcatgacgatgtgcggntgctcagtgacgccactgtggagaaaggatgagtnccatgcaggcaaggnggtgcttga

SEQ ID NO: 10595 - DNA, 397 bp, Homo sapiens
  misc_feature 16, 24, 28, 98, 149, 152, 182, 330, 377: n = A,T,C or G
aaaagctggagctcgngcgcctgnaggncgacactagtggatccaaagaattcggcacgagttatgagtcgcaccaaccggccgcctctgtccctttnccggatgatccggaagatgaagcttcctggccgggaaaacaagacggccgnggntgtggggaccataactgatgatgtgcgggntcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggncctcgcaagggccgagaggtgtaccgggcatttcggcaaggccccangaaccccgcacagccacacc

SEQ ID NO: 10596 - DNA, 400 bp, Homo sapiens
  misc_feature 16, 28, 104, 176, 188, 213, 230, 250, 317, 398: n = A,T,C or G
aaaagctggagctcgngcgcctgcaggncgacactagtggatccaaagaattcggcacgagagcgaagtaggcaggggcgaggcggctggggaccgcggggcancacgggagcgagtatgtccgctctgactcggctggcgtctttcgctcgcgttggaggccgccttttcagaancggctgcacacnggacctgctggagatggtggagtcngtcatgccggtggtgcngtgcacatttgagccccggnatagacagttccccccagctgaccagatcccaggtgttccagagcgagttcttcagcggactcatgnggttctggattctctggcgcttttggcatgactcaaaaagaggtgctgggtcacttttccggaatcctgatccttcccagngg

SEQ ID NO: 10597 - DNA, 307 bp, Homo sapiens
  misc_feature 15, 20, 33, 37, 47, 79, 85, 111, 137, 157, 159, 174, 194,204, 250, 262: n = A,T,C or G
aaagctggagctcgngcgcntgcaggtcgacantagnggatccaaanaattcggcacgaggagaagggccccgaccccntgcagnacatgcgggccgaccaggcagccggnggcctgagacagcatgacgccgaggnggatgccacactcaagtccntnaacaaccagattganagcatccgcagccccgaggnctcccgcaanaaccctgctcgcacctgcagagacctgaaactctgccaccctgagnggaagagtgganactactggattgaccccaaccaaggctgcaccttggacgccatga

SEQ ID NO: 10598 - DNA, 276 bp, Homo sapiens
  misc_feature 12, 41, 75, 98, 144, 177, 226, 228, 240, 273: n = A,T,C or G
acaataagctgnagctcgcgcgcctgcaggtcgacactagnggatccaaagaattcggcacgagtaaatcaacgnggcacaaaaggcccctacattanatactatcctgaggtcccttttacttggagtcaaaatccttagtcngatggggggaaaaggggactggaagatcggcgngcttactactaaccagtaaccaaacctcaaggttattaaggccttctgngngccagttcgaanggatgtttattgggatctggcttctgccctttntcc

SEQ ID NO: 10599 - DNA, 400 bp, Homo sapiens
  misc_feature 4, 8, 56, 154, 240, 253, 394: n = A,T,C or G
gcgnctgnaggtcgacactagtggatccaaagaattcggcacgagctcgtgccganttcggcacgagaaaaaactgtataaaagaaatatacctcaacgtactagccggatatgacagacccacagctagtatcatactgaatggggaaaaagngaaagactttcctataagatctggaacacaacagggatgttcactgtcactactgttattcaacaaagtcctggatgttctagctngagcgatcagacnagagaagatataaaggccatccaaactggaaagggagaagttgaattaccctagtttgccgatgatgtgaacttatatttggaaaaaacctaaaggctccacaggaaaactattagaatcaataaattcagtaaagttgcnggacac

SEQ ID NO: 10600 - DNA, 400 bp, Homo sapiens
  misc_feature 10, 22, 42, 90, 113, 280, 293, 314, 375: n = A,T,C or G
aagctggagntcgtgcgcctgnaggtcgacactagtggatcnaaagaattcggcacgagcttcaggggagattgtctactgtgggcaggngtttgagaagtcccccctgcggntgaagaacttcgggatctggctgcgctatgactcccggagcggcacccacaacatgtaccgggaataccgggacctgaccaccgcaggcgctgtcacccagtgctaccgagacatgggtgcccgggcaccggcgcccgagcccactccattcagatcatgaaggtgnaggagatcgcggncagcaagtgccggccggccgnttgtcaagcagtttccacgactccaagatcaagttccccgctgccccaccgggtccctgcngccgtcaggcacaagccaacgcttt

SEQ ID NO: 10601 - DNA, 400 bp, Homo sapiens
  misc_feature 24, 237, 271, 278: n = A,T,C or G
ataagctggagctcgtgcgcctgnaggtcgacactagtggatccaaagaattcggcacgaggctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgngggcaaaagagaaaaagaaggattgatcagagcnttgtgcnatacaggttcattaactccttcccccgctcccccaaaaatttgaatttttttttcaacactcttacacctgttatggaaaatgtcaacctttgtaagaaaaccaaaataaaaattgaaaaat

SEQ ID NO: 10602 - DNA, 267 bp, Homo sapiens
  misc_feature 17, 29, 79, 131, 148, 164, 263: n = A,T,C or G
aataagctgaagctcgngcgcctgcaggncgacactagtggatccaaagaattcggcacgaggccgggctggctgcggncgccctgggccgggccccaccggacggcttgctctgctctttacctggggtngctgtcgaggaccctgngcaagactcggccggnttttctttctccctgatggacagacccaaacatagccgcgcagcatcgtgaagggctggggccttcactcctctgtggctctggaaagagccccgattncctc

SEQ ID NO: 10603 - DNA, 399 bp, Homo sapiens
  misc_feature 17, 30, 39, 65, 82, 95, 103, 145, 152, 209, 244, 274, 294,301, 314, 337, 391: n = A,T,C or G
aaagcctggaagctcgngcgcctgcaggtngacactagnggatccaaagaaattcggcacgagtngttctacagatttgggngtgtacacttgtntgtgcacncagagattgtttacattgttacacattttcacttttaatctntaaaatngccatctcattttaagatgaaaatagaagctcagtttttcatgatcctggtttctgncaaattcttgatttagtaggggccaagattaccancatagataactaaagtattctacatatgangcattcctttttaaaaattngttttanaggacagaggttnaatcattctttatgaggctgagngcaggggcttacgcctgtaatcccagcactttggtaggccaagtcaggcagatnaattgagg

SEQ ID NO: 10604 - DNA, 400 bp, Homo sapiens
  misc_feature 2, 16, 93, 126, 133, 134, 195, 229, 236, 387: n = A,T,C or G
anaagctggagctcgngcgcctgcaggtcgacactagtggatccaaagaattcggcacgagggagcggaggagggcgtcacatgggtttcggngtctggcaagcgggtcagctgtctgctccctancagccgnncttcgggtcgggcgtctccgccggctactgccgcttcagttctcccggtgtggccacgagncggcacaacattctgaaattttttggttattgtnatgatgntgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctganagaagacctaaag

SEQ ID NO: 10605 - DNA, 371 bp, Homo sapiens
  misc_feature 25, 63, 105: n = A,T,C or G
aataagctggagctcgtgcgcctgnaggtcgacactagtggatccaaagaattcggacgaggntgggcttacctcctgcttcgtgaccttcctcctgccagcggnctggatcctgtcacacctggagacctacaggaggccacgagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaacttt

SEQ ID NO: 10606 - DNA, 400 bp, Homo sapiens
  misc_feature 2, 80, 111: n = A,T,C or G
anaagctggagctcgtgcgcctgcaggtcgacactagtggatccaaagaattcggcacgagctttgaactgccttgtgtnctgtgagaaacaaatatttacttagagtggnaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaaca

SEQ ID NO: 10607 - DNA, 215 bp, Homo sapiens
  misc_feature 3, 39, 81, 197, 210: n = A,T,C or G
canaagctggagctcgcgcgcctgcaggtcgacactagnggatccaaagaattcggcacgagcggcacgaggcacatgctntttgccaggcattaaactagacactaaggatatagcagaatacaaaacagaaaaacatcctcctcttgagggctatcatttttagatgtagaaaggtataataaaaggaaaaaaangggggtaattatngggat

SEQ ID NO: 10608 - DNA, 236 bp, Homo sapiens
  misc_feature 21, 38, 73, 76, 104, 113, 123, 151, 158, 170, 218, 221: n = A,T,C or G
aaaagctggagctcgcgcgcntgcaggtcgacactagnggatccaaagaattcggcacgagcccgactaggtnggntgaaaaatgattatcttaaagtataggnggaaggatncaaatgctanaaagagggaatcaaatcagccccgtttnggagggngggggacagaanatggggctacatttcccccatacctactatttttttatatcccgattngcnctttgagaatacatc

SEQ ID NO: 10609 - DNA, 186 bp, Homo sapiens
  misc_feature 4, 5, 46, 166: n = A,T,C or G
aaanntaaagcctggaagcctcgcgcgcctgcaggtcgacactagnggatccaaagaattcggcacgagtcttgtcttacggtctgcataggaaaaaacccaagctaattatcctgaaagttaagtaacatgagggctgtatttgactattggaattagcatcagnggccttgagaagactggttt

SEQ ID NO: 10610 - DNA, 289 bp, Homo sapiens
  misc_feature 27, 34, 54, 84, 88, 111, 113, 122, 135, 148, 153, 213, 229: n = A,T,C or G
atccaaagaattcggcacgaggacttntggaatntttgagaccaagttccaggnggacaaagtcaacttccacatgtttgacgngggnggccagcgcgatgaacgccgcangnggatccagngcttcaacgatgngactgccatcatnttcgngggggccagcagcagctacaacatggtcatccgggaggacaaccagaccaaccgcctgcnggaggctctgaacctnttcaagagcatctggaacaacagatggctgcgcaccatctctgtgatcctgttcctcaac

SEQ ID NO: 10611 - DNA, 303 bp, Homo sapiens
  misc_feature 17, 64, 70, 78, 93, 98, 149, 207, 276: n = A,T,C or G
aataagctggagctcgngcgcctgcaggtcgacactagtggatccaaagaattcggcacgaggnggaagngacatcgnctttaaaccctgcgnggcanttccctgacgcaccgccgtgatgcccagggaagacagggcgacctggaagnccaactacttccttaagatcatccaactattggatgattatccgaaatgtttcattgngggagcagacaatgtgggctccaagcagatgcagcagatccgcatgtcccttcgcgggaaggctgtggngctgatgggcaagaacaccatgatgcg

SEQ ID NO: 10612 - DNA, 400 bp, Homo sapiens
  misc_feature 16, 118, 185: n = A,T,C or G
ataagctggagctcgngcgcctgcaggtcgacactagtggatccaaagaattcggcacgaggtcgggtttgacatcaactgtggtgtccgcttgctaagaaccaatttagatgaaagngatgtccagcctgtgaaggagcaacttgcccaagctatgtttgaccacattcctgttggggtggggncaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattat

SEQ ID NO: 10613 - DNA, 108 bp, Homo sapiens
  misc_feature 3, 9, 35, 44, 72, 75, 102: n = A,T,C or G
aancgaaancctggaagctcgcgcgcctgcaggtngacactagnggatccaaagaattcggcacgagctcgnggnctatggagcatgctgcttgctgtctgngcagct

SEQ ID NO: 10614 - DNA, 169 bp, Homo sapiens
  misc_feature 3, 40, 115, 131, 146: n = A,T,C or G
canaaagctggagctcgcgcgcctgcaggtcgacactagnggatccaaagaattcggcacgagcctgagtatttttctttttaccagttttttagtttgagctcttaggtttatnggagctagcaataatnggttctggcaagttnggccagactgacttcaaaaaatt

SEQ ID NO: 10615 - DNA, 400 bp, Homo sapiens
  misc_feature 17, 29, 116, 124, 169, 379: n = A,T,C or G
aataagctggagctcgngcgcctgcaggncgacactagtggatccaaagaattcggcacgagcggcacgaggaatattcaccaagggtttgcatttgggaagtcccttaccagctnctgcttanagctggtagggccatacatgtccacactcccaactggtggctctnccgctgaatggggcctcagcaggtgcccaggctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggntcctctgtagtcctgctggga

SEQ ID NO: 10616 - DNA, 400 bp, Homo sapiens
  misc_feature 2, 16, 129, 155, 199, 225, 366, 395: n = A,T,C or G
anaagctggagctcgngcgcctgcaggtcgacactagtggatccaaagaattcggcacgagtaaaggcattcaggaaggagcctttgctccttccccactgagagcaaacctctgttgaattagggagngagctcctgttccactgcttagcagntttcctcagcctttttttggatatcatttctaagatctctttanacttgtggtagcatatggctgctagngtggctgtttctgtgaagaacattccacgcagaggaaccaacatgtacaaagtcctgaggagaaattaagtgtttaagaaacaacaaagaatccagtgtggttggagtggagaaagcaaggaggtgagagctgagaggtanggtttggcctaaatagaatgtctagcatnctgca

SEQ ID NO: 10617 - DNA, 259 bp, Homo sapiens
  misc_feature 20, 28, 37, 82, 92, 94, 189, 193, 211, 229: n = A,T,C or G
aaagctggagctcgcgcgcntgcaggtngacactagnggatccaaaaaattcggcacgagctcaggattccctagcctcctntgcccatcgngngcactgattggaggagtctggcccaaacactctcatatgaacctcgacatgctggagtggggtctggcaggagctgatgacagtttgagggactngagngtccctagcctggcagtnggctcccggaagcactanacactgacactcattggtagaccctccctc

SEQ ID NO: 10618 - DNA, 399 bp, Homo sapiens
  misc_feature 4, 41, 51, 83, 88, 91, 136, 170, 185, 210, 270, 310, 313: n = A,T,C or G
aaanaaagctggagctcgcgcgcctgcaggtcgacactagnggatccaaanaattcggcacgagatggcccggtccctggggngcctnggngtcatcatcttgctgtctgccttctccggacctggggtcaggggnggtcctatgcccaagctggctgaccggaagctgngtgcggaccaggagngcagccaccctatctccatggctgnggcccttcaggactacatggcccctgactgccgattcctgaccattcaccggggccaagnggggtatgtcttctccaagctgaagggccgtgggcggctnttntggggaggcagcgttcagggagattactatggagatctggctgctcgcctgggctatttccccagtagcattgtccgagaggacca

SEQ ID NO: 10619 - DNA, 398 bp, Homo sapiens
  misc_feature 5, 30, 39, 97, 361, 384: n = A,T,C or G
tgcgnctgaaggcccgacactagtggctcnaaagaattnggcacgagctgaaacctctattttctcattatgtaagttgttaatacacagtggaatntgcatttgtatgtaggatgctgtcttagcctaggctccctagaaagcacagcatgaatcaatggcttgtatactaatactttgttgtggagggaagggggttggccattgcatgttccagggaagcaagaatgaggagaaaaatgaattgaagcaagaaagataggagagcaatacaaggtggtgtgttactaaaacagccatagcttcagcacaaaacaaaagtggtcacttgatcatgtggaatggcaccaaaaaggttgantttcagaaccactctgccttggngcaggagaaggaag

SEQ ID NO: 10620 - DNA, 202 bp, Homo sapiens
  misc_feature 15, 24, 27, 31, 40, 71, 80, 89, 103, 152, 168, 174: n = A,T,C or G
gcgccttgaaggccngacactagnggnatcnaaaaaattnggcacgagcgcatgtaattaactgccttgcnacttccatntccctccgngctccagccacccntgagctgaggctcccattgtctccatcagagcctgattgtgtatgccgncctcccctggtccggngtttgngttccccacccctcacagactgcctgag

SEQ ID NO: 10621 - DNA, 268 bp, Homo sapiens
  misc_feature 11, 29, 30, 42, 201, 244, 257, 259: n = A,T,C or G
cgtgcgcctgnaggtccgacactagtggnnctaaagaatttngcacgaggcctgagggacccaaagccctcagggaggctgggtgatccaggaccccaggaggcacagaccccgaggtccatcctggctcaacagagcaagctgtccaagccccagggtgacctttctctgaggagtctgcagttccctgagaggacctgncgcctcaggccatacctgggctatgactggcattgcaggggtnttgtgggaaccangntcttcatca

SEQ ID NO: 10622 - DNA, 353 bp, Homo sapiens
  misc_feature 32, 55, 64, 83, 140, 170, 200, 221, 246, 257, 329, 340: n = A,T,C or G
cgtgcgcctgcaggtcgacactagtggcatcnaaagaatttggcacgaggctcgncaagttctnccaggagaaagccatgtancagttcgagcgccaagatcgtgaagcccaatggcgagaagccggacgagttcgagtncggcatctcccaggctcttctggagctggngatgaactcggacctcaaggctcagctcanggagctgaatattacggcggntaaggaaattgaagttggtggtggncgggaaagctntcataatctttgttcccgttcctcaactgaaatctttccagaaaatccaagtccggctagtacgcgaattgnagaaaaagttnagtgggaagcatg

SEQ ID NO: 10623 - DNA, 400 bp, Homo sapiens
  misc_feature 12, 19, 27, 43, 44, 68, 69, 76, 190, 217, 241, 265, 280,301, 364, 372: n = A,T,C or G
tggggcgcctgnaggtccnacactagnggatccaaagaatttnncacgaggcaaaggggtccatacgnngttgttntggattcccgtcgtaacttaaagggaaattttcacaatgtccggagcccttgatgtcctgcaaatgaaggaggaggatgtccttaagttccttgcagcaggaacccacttaggnggcaccaatcttgacttccagatggancagtacatctataaaaggaaaagngatggcatctatatcataaatctnaagaggacctggganaagcttctgctggcagctcgngcaattgttgccattgaaaaccctgctgatgtcagggttatatcctccaggaatactggccanagggctgngctgaagtttgctgctgccacttggagc

SEQ ID NO: 10624 - DNA, 150 bp, Homo sapiens
  misc_feature 10, 14, 29, 40, 59, 134: n = A,T,C or G
aggccgacantagnggatccaaaaaattnggcacgaggcnttcccagcagatggaacanactgaggggaggcactgggaggccctgcaaatcagccaggtttgtctggggcatgagtggcataaaggggaacantgctggcaatgttgga

SEQ ID NO: 10625 - DNA, 400 bp, Homo sapiens
  misc_feature 10, 15, 29, 86, 92, 154, 173, 188, 204, 304, 360: n = A,T,C or G
aaagctgganttcgngcgcctgcaggtcnacactagtggatccaaagaattcggcacgatccaagatggactcgactgccaacgangtggangccgtcaaagtgcacagcttccccacactcaagttctttcctgccagtgccgacaggacggncatcgattacaacggggancgcacgctggatggntttaagaaattcctgnagagcgggggccaggatggggcaggggatgatgacgatctcgaggacctggaagaagcagaggagccagacatggaggaagacgatgatcagaaagctgngaaagatgaactgtaatacgcaaagccagacccgggcgctgccgagacccctcggnggctgcacacccagcagcagcgcacgcctccgaagcctgc

SEQ ID NO: 10626 - DNA, 121 bp, Homo sapiens
  misc_feature 4, 14, 41, 57, 65, 75, 81, 91, 97, 109: n = A,T,C or G
aggncgacactagnggatccaaagaattcggcacgagtaanagattggcattaattngatttttntttttaaagnacagtngatctttggncaaaangggtatgggggngtctataatact

SEQ ID NO: 10627 - DNA, 142 bp, Homo sapiens
  misc_feature 4, 15, 55, 59, 92, 99, 131, 138: n = A,T,C or G
aggnccgacactagnggatccaaagaattcggcacgaggctgtatcctgtacttngggngaaaatgtacttgctttccctcctgttcatttngtttttntaatttcctaatatattaacgtttattccagngtttganggag

SEQ ID NO: 10628 - DNA, 400 bp, Homo sapiens
  misc_feature 17, 31, 108, 140, 150, 190, 234, 274, 292, 389, 396: n = A,T,C or G
aaaaagctggagttcgngcgcctgcaggtcnacactagtggatccaaagaattcggcacgaggaaaccttatccagccgaagaagggaactaattcagaagttgaagnctttcatcagcttctatagtgctttgcctggntacatctgcngccatagccctgtggcggaaaacgacaccctttgctggantggacaagaactcgtggagagatacagccaaaaggcagcaaggnatggaatgaaaaaccagttcaatctccatgagctgaaaangaagggccctgagccagnggtcagtcaaattattgacaaactgaagcacattaaccagctcctgagaaccatgtctatgcccaaaggtagagttctggataaaaacctggatgangaagggnttga

SEQ ID NO: 10629 - DNA, 283 bp, Homo sapiens
  misc_feature 11, 31, 64, 80, 146, 234, 281: n = A,T,C or G
cgtgcgcctgnaggtcgacactagtggatcnaaagaattcggcacgaggtttgcttaggcgcanacggggaagcggagcnaacatgccagtggcccggagctgggtttgtcgcaaaacttatgtgaccccgcggagacccttcganaaatctcgtctcgaccaagagctgaagctgatcggcgagtatgggctccggaacaaacgtgaggtctggagggtcaaatttaccctgnccaagatccgcaaggccgcccggaacctgctgacgctttgatgagangg

SEQ ID NO: 10630 - DNA, 222 bp, Homo sapiens
  misc_feature 3, 17, 32, 53, 75, 96, 108, 114, 171, 177, 185, 216: n = A,T,C or G
tgnaggccgacactagnggatccaaagaattnggcacgaggaaaaaattatcncctcattactggccagctaggngtttgctgtcaagtaaatgcntagaagaatganaagggngagcatagagcctaagaactttaggttaggcttttagacagaaaacaacaacaacancaaaancaaccctntcaagcctgcagatgttaccaaggaggaaangccagc

SEQ ID NO: 10631 - DNA, 173 bp, Homo sapiens
  misc_feature 9, 12, 38, 48, 124, 134, 139: n = A,T,C or G
aaaccctgnttntcgcgcgcctgcaggccgacactagnggatccaaanaattcggcacgagctcgtgccgaattcggcacgagggaaaccttgttcaacgcgtcccagcgcatcagcgagttanagaggaatgnggaanaacttaagcggaaagctgcccaaaactccgggga

SEQ ID NO: 10632 - DNA, 396 bp, Homo sapiens
  misc_feature 4, 6, 65, 124, 145, 204, 305, 308, 371: n = A,T,C or G
aggncnacactagtggatccaaagaattcggcacgagacaatctaaacactcaataactgccggntactattgttattatcattcccttttataattacccctcttaacacatagggatttcgngattaacgttaagcaggtggncctaagaagaattctttcttaaactttaaatcaaaacaaaacttcctttgccatccttnaagtggcacagactcatttaaacaccatccagaccaatgggatgcatcactgatagatttttaatttttatttttacagaaggaaaaaaaacccagaaagnggnggtattttaatgctggagcaaacctggcatcattttttaatgtctatctgatgacaatctggntattaggttgtcagaattttttgac

SEQ ID NO: 10633 - DNA, 400 bp, Homo sapiens
  misc_feature 23, 42, 63, 87, 92, 112, 204, 255, 370: n = A,T,C or G
tggggcaaaaaacctggttttgngtgcgcctgcaggcccganactagtggatccaaagaattnggcacgagaaggaccccatgggcnagccngaaatatactgactcttganggaaagcaggagctcagactcttaaagccagctgaggcttcggacccaaggcctgacctaggctgctatcctaatattgcaggaggggcctntcttccaagccccaccctaagggttagcccttggccaaatcttttgccgtntaggcccagccaggcttttctgactaaataagcaataagaggctctaagctgactgagttgcaaggaccctttccgccctcccttggatctccatgtttttccagatggcggaanagcatgtgccaccccctttcctaacagact

SEQ ID NO: 10634 - DNA, 398 bp, Homo sapiens
  misc_feature 11, 69, 223, 283, 295, 331: n = A,T,C or G
tggtttttcgngcgcctgcaggcccgacactagtggatccaaagaattcggcacgagcatgaacaaggnggagctggagtctcgcctggaagggctgaccgacgagatcaacttcctcaggcagctgtatgaagaggagatccgggagctgcagtcccagatctcggacacatctgtggtgctgtccatggacaacagccgctccctggacatggacagcatnattgctgaggtcaaggcacagtacgaggatattgccaaccgcagccgggctgaggctganagcatgtaccanatcaagtatgaggagctgcagagccttggctgggangcacgggggatgacctgcggcgcacaaagactgagatctctgagatgaaccggaacatcagccggct

SEQ ID NO: 10635 - DNA, 166 bp, Homo sapiens
  misc_feature 5, 12, 40, 66, 113, 124, 135, 152, 160: n = A,T,C or G
aaaanccctggntctcgcgcgcctgcaggccgacactagnggatccaaagaattcggcacgagggngttatttgtctgttaaaactagtctgcagatgtttcttgaatgcttngtcaaattaanaaagttaaagngcaataatgtttgaagncaataagngggggg

SEQ ID NO: 10636 - DNA, 100 bp, Homo sapiens
  misc_feature 2, 10, 61, 63, 72, 79: n = A,T,C or G
gngcgcttgnaggccgacactaggggatccaaagaattcggcacgagctcgtgccgaattngncacgagttnggctgcntctttatacaacttttcttca

SEQ ID NO: 10637 - DNA, 400 bp, Homo sapiens
  misc_feature 3, 14, 49, 65, 66, 96, 99, 101, 111, 131, 176, 251, 291, 315: n = A,T,C or G
cgngcgcctgcagntcgacactagtggatccaaagaattcggcacgagnaatccacccgagtggnntggaatggaatggaatgtaacgacttggantgnantggaatggantgaaatcaacccgagtggantgcaatggaatggaatggaatggaatggaatcaaccagagtggantggaatggaaaggaattgaaatgaatggaatggaatggaatggaatggaatggaatggaatggaatcaacccgantagaatggaatggaatggaatggaatggaatagaatggantcaattcgagtgcaatgttatggnatagaatggaatggaatggaatggaatggaatggaatggaatcaaccagagtggaatggaatggaaaggaattgaaatgaatgga

SEQ ID NO: 10638 - DNA, 372 bp, Homo sapiens
  misc_feature 2, 4, 40, 46, 47, 50, 51, 55, 73, 145, 160, 174, 205, 244,295, 310, 318, 336, 354: n = A,T,C or G
tngncgctaggggatccaaagatttcggcacgagaggcantacaannggnngagngtagaaacaggaagtgtncgagtttttctcacagaactttgtcatctagctcatgggataagatatgaacatgtttaagaaactatgagngattatgaggcagantaaataaaaagatncagcaaatggaaaagattaattgaatcatgnatatgttctattagttccaagaaaagataaattctttgngcacaagaaatctgataaaaatttatggaagatgaaggttttgagctcaangttacattatgtatngattttanctagaaagagagaaaatncaagaggaaaagattgtntgacattccaattgtgag

SEQ ID NO: 10639 - DNA, 516 bp, Homo sapiens
  misc_feature 6, 18, 43, 56, 57, 70, 72, 80, 95, 107, 119, 121, 129, 163,169, 205, 210, 230, 262, 271, 279, 281, 283, 285, 291, 295,300, 308, 312, 336, 343, 353, 412, 436, 461, 469: n = A,T,C or G
tgaagncccgacactagnggatccaaagattttggcacgaggngctgtccgccctnntcctgctggactntntgcactgngtcctgatcaccctntcagctgatagngggcactgcagngngaatcttntcatggacaacagaccaatcctgcctccaccagngccgtngccaaatcagtaacacagagcaacctcaaacatttntgaangtttaggtcatctaatactnggcaaaagagggggccgaacacctccaccctnagctttctnttctgttngngngngagggngtgnagcanagtctganaaanatacatacagccaccttccttttntgagctngggaaaattngaacaagagcactgaaatgcaaacactaatcaaaaaggaagtattttccattttaattntaaagaggggaaatagaaaaaaangattttgctaaaacaaaatatgcanacaccttngggaaaacgggctataaaggaaccatgctaactccagagatgaccca

SEQ ID NO: 10640 - DNA, 400 bp, Homo sapiens
  misc_feature 3, 20, 102, 190: n = A,T,C or G
tgnagtcttgtgcgcctganggtgcgacactagtggatccaaagaattcggcacgagctctcctgctgaatatcgttcacctgcaatcctatgggataaagntcaaatttcttagcatggcatgtgaaactctccagtatctggctataacctagttctccaattccaatcccagctcttggaccatctncaaactctctcttgcagtcatttggagctcctggtaggtagctagtcaggcaggagcagagcaggagagggctacccccaccaacaagaaatgtcaggcaaccaacaggtgatggtcaggcaattgtcacattgcctctctgaaagaataattggtcacagccagcaccagagagaggcagcttcccaatagataaaaacatctgtaact

SEQ ID NO: 10641 - DNA, 208 bp, Homo sapiens
  misc_feature 5, 9, 63, 68, 72, 109, 136, 168, 185, 193: n = A,T,C or G
gacantagnggatccaaagaattcggcacgagattccatgatacaattcaccagtaacctatnttacntganattcggaagtaagttaagaaggcattagtcatggttnggaagcaccatacagggagacagctgngtgaatacaggctgtatggacacttgcttccntcccattttcctgcttntttgggtngccaatcaagagtat

SEQ ID NO: 10642 - DNA, 398 bp, Homo sapiens
  misc_feature 97, 99, 211, 323, 349: n = A,T,C or G
gatccaaagaattcggcacgagtttggaccgggattttctctctgtcttctctctgggtgtgtgggtgggtatgtacagaagggctaccaaggaagngncaaccatgttagattttctgtagtcttccagaaacagtgcagcccatacaacaggaatcttaattttcctcacagcaaatataacaggatggaacagttagtgttttgtttncacaagtgtccaccactccatctgccctgcatggagagggctctctcactgctagatctaggctgagccatctggaaggatcaaagggtgtgggagtatcaccccctctcangctgcagaaggtctcgagggtggcgncacagcaggatttccgccttctgcattgcactgcacagccccatggaac

SEQ ID NO: 10643 - DNA, 400 bp, Homo sapiens
  misc_feature 22, 26, 29, 69, 133, 158, 246, 247, 259, 297, 302, 349, 356,395, 397: n = A,T,C or G
aataagcgtggagctggtgcgnctgnggncgacactagtggatccaaagaattcggacgagccgagagnaaatcatctttccaatccagaggaacaagcatgtctctctgccaagatccatctaaactggagngatggtagcagacccagcttagagntcttctttctttcttaagccctttgctctggaggaagttctccagcttcagctcaactcacagcttctccaagcatcaccctgggagnntcctgagggttntctcataaatgagggctgcacattgcctgttctgcttngaagnattcaataccgctcagtattttaaatgaagtgattctaagatttggnttgggancaataggaaagcatatgcagccaaccaagatgcaaatgntntga

SEQ ID NO: 10644 - DNA, 395 bp, Homo sapiens
  misc_feature 4, 21, 23, 33, 40, 49, 73, 106, 112, 176, 191, 194, 229,231, 246, 298, 329, 389: n = A,T,C or G
gggnaaataaaacctggaatntngcgccgcttncagggtngacactagnggatccaaagaattcggcacgagnggacatccgcaaagacctgtacgccaacacagngctgtntggcggcaccaccatgtaccctggcattgccgacaggatgcagaaggagatcactgccctggcncccagcacaatgaanatnaagatcattgctcctcctgagcgcaagtactccgngnggatcgggggctccntcctggcctcgttgtccaccttccagcagatgtggatcagcaagcaggagtntgacgagtccggcccctccatcgtccaccgnaaatgcttctaggcggacttatgacttagttgcgttacaccttttcttgacaaaacctancttgcg

SEQ ID NO: 10645 - DNA, 226 bp, Homo sapiens
  misc_feature 8, 12, 37, 50, 54, 58, 82, 91, 101, 113, 123, 173, 197, 214: n = A,T,C or G
tgggagantagnggatccaaagaaattcggcacgagntcgtgccgaattnggcncganaaaaataatcagagatgtgaacantcatagacntacagatatnttctgaaatatntgctcggagngcccacaacagattaccctgggcacctgttaacaaggggcattaggctgnggttcacacctccaatcccagcantttgggaggccaaggcngacagatcacct

SEQ ID NO: 10646 - DNA, 113 bp, Homo sapiens
  misc_feature 3, 40, 87, 106: n = A,T,C or G
canaaagctggagctcgcgcgcctgcaggtcgacactagnggatccaaagaattcggcacgagagcaatctttattctatacatttnatgggaacttttttaatgnctttaat

SEQ ID NO: 10647 - DNA, 289 bp, Homo sapiens
  misc_feature 17, 25, 29, 69, 72, 207, 277: n = A,T,C or G
aataagctggagctcgngcgcctgnaggncgacactagtggatccaaagaattcggacgagctcgtgcnganttcggcacgagcttagctgtaacttaactattaaggccttttccacacgcattaatagccccatttttctcttgccatttgtagctttgcccattgtcttattggcacatgggtggacacggatctgctgggctntgccttaaacacacattgcagcttcaacttttctctttagtgttctgtttgaaactaatacttaccgagncagactttgtgt

SEQ ID NO: 10648 - DNA, 100 bp, Homo sapiens
  misc_feature 7, 19, 30, 47: n = A,T,C or G
aaacaanaagcctggaagnctcgcgccgcntgcaggtcgacactagnggatccaaagaaattcggcacgaggggacggggagaaagagagagcgcgaaag

SEQ ID NO: 10649 - DNA, 133 bp, Homo sapiens
  misc_feature 5, 42, 46, 75, 105, 122, 126: n = A,T,C or G
aaccnaaaagcctggaagcctcgcgcgcctgcaggtcgacantagnggatccaaagaattcggcacgaggaggtntggggcagattctccctaagggctcctaanaaggaaccaatcctgcnggtnccttgat

SEQ ID NO: 10650 - DNA, 116 bp, Homo sapiens
  misc_feature 5, 9, 36, 50, 70, 73, 94: n = A,T,C or G
gacantagnggatccaaagaattcggcacgagcggnacgagcggcagccntcaggtaagccaagatgggngcntacaagtacatccaggagctntggagaaagaagcagtctgatg

SEQ ID NO: 10651 - DNA, 288 bp, Homo sapiens
  misc_feature 12, 21, 29, 38, 63, 73, 78, 106, 118, 147, 155, 169, 213,215, 238, 271: n = A,T,C or G
aaaagctggagntcgcgcgcntgcaggtngacactagnggatccaaagaattcggcacgaggntgccccggcntcctnggagagcagcagcaccaaccacagcatngggagcacccanagcaccccctgctccaccagcagcatggnatagcccnggccccccgcgctngcccagcaggagagactgagcagccgccagctgggagcactggngngaactcaccctgggagccagtcntccactcgacccagaatggagcctgttttccgngcttacccttcccgcct

SEQ ID NO: 10652 - DNA, 109 bp, Homo sapiens
  misc_feature 19, 28, 41: n = A,T,C or G
gcaggtcgacattagtggntccaaaganttcggcacgaggngagagagagagagagagagagagagagagagagagagagagagagagagagagagagagagagagaga

SEQ ID NO: 10653 - DNA, 397 bp, Homo sapiens
  misc_feature 15, 62, 142, 249, 260, 340: n = A,T,C or G
aagctggaagctcgngcgcctgcaggtcgacactagtggatccaaagaattcggcacgaggngggatctcaccgtgggtccgattatccttttctctgccttgcttgcttgagcttcagcggaattcgaaatggctggcggnaaggctggaaaggactccggaaaggccaagacaaaggcggtttcccgctcgcagagagccggcttgcagttcccagtgggccgtattcatcgacacctaaaatctangacgaccagtnatggacgtgtgggcgcgactgccgctgtgtacagcgcagccatcctggagtacctcaccgcaagaggtctttgaacctgncaggaaaatgcatcaaaaagacttaaaggaaaagcggtattacccctcgtcacttgc

SEQ ID NO: 10654 - DNA, 363 bp, Homo sapiens
  misc_feature 3, 25, 29, 64, 69, 83, 121, 125, 128, 166, 168, 182, 221,270, 337: n = A,T,C or G
aanaagctggagctcgtgcgcctgnaggncgacactagtggatccaaagaattcggacgagctnggatncattagccaagggnagggggcccctttgctgaccctccccaaaggctttgcngtgntgncctccccctcctctccaccatcgtcttcttggccatgngnggcctttccctaanccagctgcccccagagccacagttcccctatgtggaagnggggcgggcttcatagagacttgggaatgagctgaaggagaaacatttnctccctggatttttaccagtctcacatgattccagccatcaccttagaccaccaagccttgattgcngttgccaggttgtcctccttccgggg

SEQ ID NO: 10655 - DNA, 250 bp, Homo sapiens
  misc_feature 2, 22, 39, 64, 109, 134, 157, 160, 191, 204, 221, 227: n = A,T,C or G
cnaaagctggggctcgcgcgcntgcaggtcgacactagnggatccaaagaattcggcacgagtncaaaaatcccaaattcactttattattttgcttcaggatccaagngacaaagttatatatttataaaatngctataaatcgacaaaatctaangtngtctttttaatgttagggatccacctgcctnagcctcccaaagngctgggattacaggctngaaagnctaacttttttttacttatatat

SEQ ID NO: 10656 - DNA, 398 bp, Homo sapiens
  misc_feature 15, 23, 146, 149, 195, 273, 318: n = A,T,C or G
aagctggaagctcgngcgcctgnaggtcgacactagtggatccaaagaattcggcacgagaaaggaaaactgaagcccaacctaggcaacggggcagacctgcccaattaccgctggacccagaccctgtcggagctggacctggnggnccctttctgtgtgaacttccggctgaaagggaaggacattggtggnggacatccagcggcggcacctccgggtggggctcaaggggcagccagcgatcattgatggggagctctacaatgaagngaaggtggaggagagctcgtggctcattgaggacggcaaggtggngactgtgcatctggagaagatcaataagatggagtggtggagccgctttggtgtccagtgaccctgagatcaacaccaag

SEQ ID NO: 10657 - DNA, 400 bp, Homo sapiens
  misc_feature 2, 25, 66, 100, 108, 136, 191, 382: n = A,T,C or G
cnaagctggaagctcgtgcgcctgnaggtcgacactagtggatccaaagaattcggcacgaggcgntataacaaatgtgcctattataatgaggaatggnactaccgntccagattttctgtaattgcttctgcanagtaataggcttcttgtcccttttttttctggcatgttatggaatgatcattgtnaatcaggaccatttatcaagcagtacaccaactcataagatcaaatttcattgaatggtttgagggtgtagctctataaatagtagtttttaacatgcctgtagtattgctaactgcgaaaacatactctttgtacaagaagtgcttctaagaatttcattgacattaatgacactgtatacaataaatgngtagtttcttaatcgcac

SEQ ID NO: 10658 - DNA, 328 bp, Homo sapiens
  misc_feature 2, 23, 40, 105, 126, 190, 200, 211, 306, 323: n = A,T,C or G
cnaaagcctggggctcgcgcgcntgcaggtcgacactagnggatccaaagattcggcacgaggcttatgccaaaaaaaatgatacatatgcctaaaagcaaaagngaagaaagagggaaaaattgnggatggttgttcttgtttaaaaacgttctaaaagattttagtaatgagactggggacataaaanaattgaagtntagggctaagncatgaaagacaaactttgagatgaaaagaatctagagttgaaaataaaaacaagattcttactttttctttcctttacatgcctttgaaattcanagcagggctctgggggncagga

SEQ ID NO: 10659 - DNA, 129 bp, Homo sapiens
  misc_feature 28, 34, 54, 68, 95, 98, 121, 124: n = A,T,C or G
tgcgggcgcctgaaggcccgacactagnggatcnaaagaaatttggcacgaggnacatttccccttanggggacgatgctctgactcgttaaggnagnacacattgaccaccttccattcnatnaaata

SEQ ID NO: 10660 - DNA, 199 bp, Homo sapiens
  misc_feature 12, 37, 153, 160: n = A,T,C or G
ccgcgcgcctgnaggtccgacactagtggatccaaanaatttggcacgagaacttaaaattaatataggcacaggaaaagagaaaagtgtgcgctccattctcagtgggggttcaccacaaaacacgggccccaggagggaagcgctgtctangcacacnggcaaggccttagtaacagcatgctacactgctcgaggt

SEQ ID NO: 10661 - DNA, 317 bp, Homo sapiens
  misc_feature 2, 6, 279, 289, 295: n = A,T,C or G
tntcgngcgcctgcaggtccgacactagtggatccaaagaattcggcacgaggtggggaacatgtctgagtcggagctcggcaggaagtgggaccggtgtctggcggatgcggtcgtgaagataggtactggttttggattaggaattgttttctcacttaccttctttaaaagaagaatggggccattagccttcggttctggcatgggattaggaatggcttattccaactgtcagcatgatttccaggctccatatcttctacatggaaaatatgncaaagagcangagcantgactttcactctgagaacatc

SEQ ID NO: 10662 - DNA, 143 bp, Homo sapiens
  misc_feature 24: n = A,T,C or G
cacgagaatgagtggccagcgccngggcccaggcccatgtggcctgcccagcctcaatgtcacttggcggcggggtggggtgggggtggtcagcaccatccccagccttgagatgcttcactttccttctctgtaaccagact

SEQ ID NO: 10663 - DNA, 227 bp, Homo sapiens
  misc_feature 5, 69, 204: n = A,T,C or G
tcgcncgcctgcaggtcgacactagtggatccaaagaaattcggcacgagcagacttgaatgataatcngcatataggtgagagttgtcatcatatagatgagagttgaagccatgggaaagtgtatattgtgagaagaaaaagtggtcaagaagaaaattttgaagaacacaaacattgaaatgactgggagaggaagtgggncctggaaaggaaactgaattgac

SEQ ID NO: 10664 - DNA, 143 bp, Homo sapiens
  misc_feature 25, 29, 46, 75, 76, 79, 81, 85, 87, 103, 121: n = A,T,C or G
tcggcgccgcctagaggcccgacantagnggttcccaagaaaattnggcacgagaaaagcacctcaaagaggttnnggntngaangnctcttcaatcctccanaaaagtctgaagaatgangagaaactgaaaaaggaggaag

SEQ ID NO: 10665 - DNA, 244 bp, Homo sapiens
  misc_feature 40, 71, 72, 218, 219: n = A,T,C or G
ctcgcgcgccctgaaggccccgacactagtggatccaaanaatttggcacgaggaactagtctcttactgnngatgctggaagcatttgattattagaggcacaggagtaatgatattgtaaccatagagaaggaactatgatcactcacaatacactccttggggaacaaagtcacataatcaacaacataaacactgagcctcattttcatagacnnagaggaaaggcttaataattaagga

SEQ ID NO: 10666 - DNA, 398 bp, Homo sapiens
  misc_feature 17: n = A,T,C or G
cgccgcgcctgcagganccgacactagtggatccaaagaaatttggcacgaggaataccaaggacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcaggcaatatattaccagcaagaataaaaaagaaatccatatcttaaagaaacagcttttaagggcct

SEQ ID NO: 10667 - DNA, 201 bp, Homo sapiens
  misc_feature 5, 13, 138: n = A,T,C or G
tcgcngcgcctgnaggtccgacactagtggatccaaagtaatttggcacgagccgactcgcaagatggcgccgcagaaaagacaggaagcccaagaggtcaacctggaggtttaatttggaccttactcatccagtanaagatggaatttttgattctggaaattttggtaccttccctagtgaatatctagggttctctt

SEQ ID NO: 10668 - DNA, 364 bp, Homo sapiens
  misc_feature 70, 219, 220, 296, 298, 299: n = A,T,C or G
ctcgcgcgcctgcagcccgacactagtggatccaaaaaattcggcacgagctgacctatgatgaagcggngcaagcttgtctcaatgatggtgctcagattgcaaaagtgggccagatatttgctgcctggaaaattctcggatatgaccgctgtgatgcgggctggttggccggatggcagcgtccgctaccccatctctaggccaagaaggcgctgnngtcctactgaggctgcagtgcgcttcgtgggtttcccagataaaaagcataagctgtatggtgtctactgcttcananncaccacacctggaatgtgccccttagagcgcatcagttttaaagtcattaagaacatgtgaaagg

SEQ ID NO: 10669 - DNA, 210 bp, Homo sapiens
  misc_feature 40, 63, 67, 68: n = A,T,C or G
ctcgcgcgcctgcaggcccgacactagtggatccaaatantttggcacgagtgcagacctgcngggnnagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgac

SEQ ID NO: 10670 - DNA, 399 bp, Homo sapiens
  misc_feature 16, 215, 218, 219: n = A,T,C or G
tcgcgcgcctgcaggnccgacactagtggatccaaagaattttgcacgagcggcacgagccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagtnggnnctgtttgttttcttggctaagattaagacaaagaacatatcaaatcaacagaaaatataccttggggccaccaacccattttgtgccacatgcaagttttgaataaggatggtattagaaaacaacgctgcatatacaggtaccatttaggaaataccgatgcctttgtgggggcagaat

SEQ ID NO: 10671 - DNA, 160 bp, Homo sapiens
  misc_feature 9, 18, 44, 47, 68, 75, 83, 95, 108, 122, 126: n = A,T,C or G
tccaaaaanttcggcacnagtggtgatatgaggggggggaggcngcncccaggaaaaaacagggcagnggaccantgaacagntccaccagctcnacatttttggaanctagatttgggganaganaagctctaccccagacttaatacccattgaaatt

SEQ ID NO: 10672 - DNA, 193 bp, Homo sapiens
  misc_feature 31, 63, 64, 71, 143, 146, 184, 193: n = A,T,C or G
ctcgcgcgcctgcaggcccgacactagtggnatccaaagtaatcggcacgagcaatattgctnnatacagntcttgtatttgaaaggaattgatccttttaaaggaacatggggtatattgttcttacaggactaatttcagnggngtaaataataaatatcttttcttaaaaaaaaaaaaaanaaaaaaaan

SEQ ID NO: 10673 - DNA, 221 bp, Homo sapiens
  misc_feature 5, 45, 71, 142, 218: n = A,T,C or G
tcgcnccgcctgaaggtccgacactagtggatccaaacaattttngcacgaggcgacattagctagcgctngctctactctctctaacgggaaagcagcggaatacaagagactgaactgtatctgcctctatttccaaaanactcacgttcaactttcgctcacacaaagccgggaaaattttattagtcctttttttaaaaaaagttaatataaanagg

SEQ ID NO: 10674 - DNA, 397 bp, Homo sapiens
  misc_feature 3, 56, 57, 82, 144, 235, 317: n = A,T,C or G
aanagaaaaaaaacctgtttttcgcgcgcctgcgggccgacactagtggatccaannaattcggcacgagcgggcatgaaangggggcacacacacacaaaaaaaaaccctgtttatactttgccaacaacacccccctccatnttatttactttgaacattccagccatctctctgcagtaattcctgctggctaatgaggattccacacagctagggaacatgacagcctgcngagggattattttcctgaacaatctgcattttaagataagtcaccttgttggaaaccttttctacccttcattggaaagggngactctctttgaagacagtttgaccaaacaatgagatctaggtgaatttgagggaagatagaacgggcactccagaaaat

SEQ ID NO: 10675 - DNA, 162 bp, Homo sapiens
  misc_feature 74, 158: n = A,T,C or G
tcgcgccgcctgaaggtcgacactagtggatccaaaaaattcggcacgagcttaacatttttcatattcgaagnggttgtctctgcactatttactgaaaagttcatcctttccccagtgatttgtaacactgcctctttcataaattaaatttttgngtat

SEQ ID NO: 10676 - DNA, 398 bp, Homo sapiens
cgcgcgcctgcaggcccgacactagtggatccaaagaattcggcacgaggcctgttgtatatgaaattgtctagaattcaggtgcaggtctttgccggttaagtaagggagcaacacgtaaaatgggagaggagtggggtgtactcacttgcctcctcttttgtcctgatttaaccagcatttttcaaccctgggaaaatttgcagaatctaaggggattgtaatgattttgagctgcagcagctttaactcttaccctttttccacatagttatggtgtttgagttggaaagaaacaactataggtagctacacgtacataattatctctttattcacaaagggtatagtaaaattgattgtaaataactttctaagtgccaatattcaaaactttt

SEQ ID NO: 10677 - DNA, 164 bp, Homo sapiens
  misc_feature 9, 17, 35, 54, 58, 59, 65, 84, 156: n = A,T,C or G
tgaaggtcnacactagnggatccaaagaatttttnacgagcgtacactaaactnttcnngctttngcattataaggaattaagnctccgattattaggggatcaccctggatgatcaggttttctgctgaaggcacctactcagtatcttttcctntttatcac

SEQ ID NO: 10678 - DNA, 311 bp, Homo sapiens
  misc_feature 9, 37, 63, 216, 217, 220, 266: n = A,T,C or G
tcgcgcgcntgaaggtccgacactagtggatccaaanaatttttcacgagccgtgaggagggntcccctcttgagctggaacgcctgaaactggagcctcacgaagggctgctgctccgtttcccctacgcggcctgacttcagcctgacatggacccactacccttctcctttccttcccaggccctttggcttctgatttttctcttttttaanngcnaacaaacaaactgttgcaggattatgagtgaacccccaaatagggngttttctgccttcaaataaaagtcacccctgcatggggaagtctt

SEQ ID NO: 10679 - DNA, 188 bp, Homo sapiens
  misc_feature 11, 42, 63, 119, 131: n = A,T,C or G
cgcgcgcctgnaggtccacactagtggatccaaagaattttncacgagctgtccctaacattngacagttttttcctccttgccagtgttaaggagattctttcttcctcacttcaganacagcttaatgngttgtatttggatgtagggatgtgtcagttacctattgctacatgacaaccgaattc

SEQ ID NO: 10680 - DNA, 269 bp, Homo sapiens
  misc_feature 11, 42, 43, 144, 151, 218, 219, 233: n = A,T,C or G
cgcgcgcctgnggtccgacactagtggatccaaagaaattcnncacgaggtaagggctgaggatttttggtccgcacgctcctgctcctgactcaccgctgttcgctctcgccgaggaacaagtcggtcaggaagcccgcgcgnaacagcnatggcttttaaggataccggaaaaacacccgtggagccggaggtggaaatttcaccgaattcgaatnnccctaacaagccgnaacgtaaaatccttggaaaggtgtgtgcctgacttg

SEQ ID NO: 10681 - DNA, 120 bp, Homo sapiens
  misc_feature 4, 22, 30, 42, 43, 60, 68: n = A,T,C or G
tagnggatccaaaaaattcttnacgagaanacagtgaggccnnggcctagggggccacgnagcttttnaacaaccatgttactccacttccccaccccaaccaggcctccctcctcccct

SEQ ID NO: 10682 - DNA, 100 bp, Homo sapiens
  misc_feature 4, 11, 63: n = A,T,C or G
tcgnaggtccnacactaggggatccaaagaaattcggcacgagctttatccacatacatgccngaaaatggttttacattttaaaggttaactactttat

SEQ ID NO: 10683 - DNA, 205 bp, Homo sapiens
  misc_feature 5, 15, 60, 80, 81, 83, 86: n = A,T,C or G
aaaanaaaacctggngtctcgcgcgcctgcaggtcgacactagtggatccaaaaaattcngcacgagccgggaccatctnntnggncatctcctgcttctgggacctgccagcaccgtttttgtggttagctccttcttgccaaccaaccatgagctcccagattcgtcagaattattccaccgacgtggaggcagccgtcaaca

SEQ ID NO: 10684 - DNA, 306 bp, Homo sapiens
  misc_feature 11, 40, 215, 305: n = A,T,C or G
cgcgcgcctgnaggtcgacactagtggatccaaagaattntgcacgagcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggngtaccggcatttcggcaaggccccaggaaccccgcacagccacaccaaaccctacgtccgctccaagggccggaagttcgagcgtgccana

SEQ ID NO: 10685 - DNA, 369 bp, Homo sapiens
  misc_feature 41: n = A,T,C or G
cgcgcgcctgcaggtcgacactagtggatccaaagaattcngcacgagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcgggggaccctttg

SEQ ID NO: 10686 - DNA, 387 bp, Homo sapiens
  misc_feature 43, 218, 220, 227, 271, 360, 374: n = A,T,C or G
cgcgcgccctgcaggtcgacactagtggatccaaagaaattcngcacgagctcgtgccgaattcggcacgagcttgactccgctgctcgccatgtcttctcacaagactttcaggattaagcgattcctggccaagaaacaaaagcaaaaatcgtcccattccccagtggattcggatgaaaactggaaataaaatcaggtacaactccaaaaggggnangtggggngaagaaccaagctgggtctataaggaattgcacatgaaatggcncacatattttatgctgtctgaaggtcacgatcatgttaccatattcaagctggaaaatgtcaccactatctggagatttccgacggggntttcctctctgaantctgttaatgaac

SEQ ID NO: 10687 - DNA, 383 bp, Homo sapiens
  misc_feature 42, 67, 218, 220, 305: n = A,T,C or G
cgcgcgcctgcaggtcgacactagtggatccaaagaattttncacgagtctggaccgtgctgaaggngtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagcnancctggaggagaagaggaaagagaaagccaagatccactaccggaagaagaaacagctcatgaggctacggaaacaggccgagaanaacgtggagaagaaaattgacaaatacacagaggtcctcaagacccacggactcctggtctgagcccaataaagactg

SEQ ID NO: 10688 - DNA, 102 bp, Homo sapiens
  misc_feature 3, 21, 41, 62, 65, 69: n = A,T,C or G
cgngcgcttgaaggtcgacantagtggatccaaaaaatttngcacgagcacgatctggactnganctcntttgaactggacttacagttttccgaagataag

SEQ ID NO: 10689 - DNA, 206 bp, Homo sapiens
  misc_feature 35, 42, 59, 67, 69: n = A,T,C or G
cgcgcgcctgcaggtcgacactagtggatccaaanaattttncacgagctcgtgccgangggggggngngcagaaggactcctacgtgggcgacgaggcccagagcaagcgtggcatcctgaccctgaagtaccccattgagcatggcatcgtcaccaactgggacgacatggagaagatctggcaccacaccttctacaacgagc

SEQ ID NO: 10690 - DNA, 400 bp, Homo sapiens
  misc_feature 12, 53, 73, 74, 77, 227, 228, 237, 329, 333, 360: n = A,T,C or G
aaaacctggttntcgcgcgcctgcaggccgacactagtggatccaaagaattnggcacgagatctcactaatnnggnggggattaacactctctgccccttctcatatcccaagctcagtgttttgatatttaattacagggaattctttcctcttcatagatgatatagcaattgtatttcatttctcttatctgaaatctctgctgactttccatgtcttatgannggaaatagnctaaatagggcatgagatcttaaatattccttccagtttctacatttgctattcagcaacaacattttccccggaaaagggtgaaagcctgngagncccccacaggggcaaggagcacctgantacacccacattttccctaccatctgacatagatgagaca

SEQ ID NO: 10691 - DNA, 355 bp, Homo sapiens
  misc_feature 1, 2, 60, 61, 62, 237: n = A,T,C or G
nnaaacaaaaacctggagttcgcgcgcctgcaggtcgacactagtggatccaaaaaattnnncacgagggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcngagaaaggcaaacgagaaagaaggaggaacccaagtagctttgtggcttcgtgccaaccctcttgcccttcgcctgtgtgcctggagccagtccccaccacgctcgcgtttcctcctg

SEQ ID NO: 10692 - DNA, 400 bp, Homo sapiens
  misc_feature 5, 277: n = A,T,C or G
aaaanctggagctcgcgcgcctgcaggtcgacactagtggatccaaagaattcggcacgagggattatgaggtcatatctcaaaatgtcagaaaacgttatagagcactcgaacttttgtatttgctgcttaacctcaatattacagccacaaacaaggggtaccaagacaaagtataactgagcataagcagaaaatgttaaccctccaggtttctttcttaagcacaataaaagtgggagcgaacaacacaaggatatttttacatttgacccgnctcaaaagtagcacaccctatccttgtgccattatttgtacaaggaaatatatgattagaaggaatagaacccccagttgtcatcagcttttttagacaccacaggttgtagcagtttgaaca

SEQ ID NO: 10693 - DNA, 374 bp, Homo sapiens
  misc_feature 6, 12: n = A,T,C or G
aaaacnctggtnctcgcgcgcctgcaggccgacactagtggatccaaagaattcggcacgaggaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 10694 - DNA, 162 bp, Homo sapiens
  misc_feature 19, 22, 112, 123: n = A,T,C or G
tgcacgagccgacaccagnggnctccaccatgccgccgaagttcgaccccaacgagatcaaagtcgtatacctgaggtgcaccggaggggaagtcggtgccactttctgccntggcccccaanatcggccccctgggtctgtctccaaaaaaagttggtgat

SEQ ID NO: 10695 - DNA, 193 bp, Homo sapiens
  misc_feature 42, 68: n = A,T,C or G
tcgcgcgcctgcaggtcgacactagtggatccaaaaaatttngcacgagggtgtccggaggcgctggnccagccttccttcctgggtatggaatcttgcggcatccacgagaccaccttcaactccatcatgaagtgtgacgtggacatccgcaaagacctgtacgccaacacggtgctgtcgggcggcacca

SEQ ID NO: 10696 - DNA, 281 bp, Homo sapiens
  misc_feature 152, 173, 251, 276: n = A,T,C or G
cacgagctcgtgccgaattcggcccgaggaagaatgtgcccatcgaggaagcccccttcctaaaaagaggaaaggacggcctcctggacacatcctgtcaagcgaccgggcagccgccggcatggtatggaaaccaaaatcctgtgaaccanttcgccgggaaggccccaagngggacccagcctcgcctgaatgaatctaccacctttgtgttgggatctcgagccaacaaagccctggggatggggggncaccaggaggaagaatctacatcangccac

SEQ ID NO: 10697 - DNA, 243 bp, Homo sapiens
  misc_feature 19, 23, 92, 136, 165, 180: n = A,T,C or G
cacgagggacgaagcaggnagcnccctcaagaaggccctgctcatccagggctccaatgacgtggagatccgggcagagggcaatagcaggntcacgtacactgccctgaaggatggctgcacgaaacataccggnaagtggggcaagactgttatcgagtaccnggtcacagggggggncacgcctccccatcattgacattgcacccatggacataggagggcccgagcaggaattcgggg

SEQ ID NO: 10698 - DNA, 304 bp, Homo sapiens
  misc_feature 12, 16, 193, 214, 221: n = A,T,C or G
tcgcgcgcctgnaggncgacactagtggatccaaagaatttggcacgagcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcanaacaagaacagcagctacttnggggagnggatccccaacaacgtgaagacggccgtgtgcgacaatcccgccccgcggcctgaagatgtcggccaccttcatcggcaacag

SEQ ID NO: 10699 - DNA, 175 bp, Homo sapiens
  misc_feature 3, 17, 27, 29, 44, 59, 86, 122, 125, 152: n = A,T,C or G
tgnaggccgacactagnggatccaaanantttggcacgagtggnagtggacatccgccntaacaaggaccgaaaggttcggcgcanggagcccaagagccaggatatctacctgaggctgtnggncaagttatacaggtttctggccagaanaaccaactccacattcaaccagg

SEQ ID NO: 10700 - DNA, 199 bp, Homo sapiens
  misc_feature 29, 162, 179, 180, 195: n = A,T,C or G
gcacgaggagacccgccccgacggacggngacaggcgaagagccgaactcgctcgatggcgtggtggagccaggaggctcgcctgactgcatggggggactggggaacccgcctaaggtgagaggtcttaagagactagcttgacgaattggggatgtcaanaaactcctccttggggnngcaggggggcctaanagag

SEQ ID NO: 10701 - DNA, 400 bp, Homo sapiens
  misc_feature 11, 29, 54, 79, 230, 248, 327, 350: n = A,T,C or G
aaaaacctggntttcgcgcgcctgcaggncgacactagtggatccaaagaattnggcacgaggaaaatctccatgttgnctccatttggctcaggaagattctttgccttacctttcttagaactctttattgcttatcaaaagtttgagtacccgcttggttttttttggtaattaaatattgtatgatttatctggttcaaggaagatgcactattcagttatctatngagaaattattttgcagnggttttagtgggtgaaaatgtcccatctgcaccagtacacaggcaggcattatcattcttcacctactttttaaatagnggcaacttgggattcattctggngattctgaaccttgcctcatagcttaaagtataaaaaagattcaagagca

SEQ ID NO: 10702 - DNA, 384 bp, Homo sapiens
  misc_feature 12, 16, 41, 216, 217, 218, 294, 297: n = A,T,C or G
tcgcgcgcctgnaggncgacactagtggatccaaagaattnggcacgagcctcttatcccacctaccttcatcaattactggtctgccttctgttactgtagatttgtttgcattttccagaattttgtataaatggaatcatatagtatgtatgttttttcactccacataattcaatatttctccatgttatgttaccaatagttaattccttnnnattgagatataatatttcattatctcacaatttatctgttcatctgatggatattggtttacttctattttttagntgnaataaagctgatgtgaatacttgtgtacaagtctttttatggacacatgctttcatttctcttggaggaatacatgggagtataatg

SEQ ID NO: 10703 - DNA, 197 bp, Homo sapiens
  misc_feature 3, 16, 35: n = A,T,C or G
ganaaaaaaacctggnttctcgcgcgcctgcaggncgacactagtggatccaaagaattcggcacgaggccagctgcactgatgctgcccctcatctctctgcccaacccttccctcaccttggcaccagacacccaggacttatttaaactctgttgcaagtgcaataaatctgacccagtgcccccactgaccag

SEQ ID NO: 10704 - DNA, 112 bp, Homo sapiens
  misc_feature 5, 8, 27, 43, 56, 60, 64, 72, 95: n = A,T,C or G
aaagnggntacaaaactatttcggcantgcatgacaattaagngtgttgttggggncaanggcnctgttgcnaaaacatgtctcctgatatcctncacaacaaacaaatttc

SEQ ID NO: 10705 - DNA, 398 bp, Homo sapiens
  misc_feature 5, 7, 76, 224, 226, 227, 343, 379, 393: n = A,T,C or G
cctgntnctcgcgcgcctgcaggccgacactagtggatccaaagaattcggcacgagtagatgccaaacagcttgnggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatnannggaactgataagcactttttgtgtcaatataaaatatactaaaactgatgaaatgctaagacatgtcttgtgaaggaaggtttcttggagaccacttttatttactcatgagaagnggaagctcctagtatcagaagaagctgatacatagngtcatgtgctcagnggttg

SEQ ID NO: 10706 - DNA, 329 bp, Homo sapiens
  misc_feature 4, 28, 227, 317: n = A,T,C or G
aaancctggtgctcgcgcgcctgcaggncgacactagtggatccaaagaattcggcacgagtggttgtcatacattatttcttacctatgcttggtttttgtttgcttgtctgttgtttatcattctgtttgattctgagtatttccttctgtggttctgaagcactgttcacatctccaacataatgtgcagcatttcttcaaacaatctagagagtagcactggnatttaaactagacatacatgtaaaaaaaaatcattattagaaagaatgttttaaaataaactagataaattttaaataattataagcagntgattcaggagt

SEQ ID NO: 10707 - DNA, 400 bp, Homo sapiens
  misc_feature 11, 12, 29: n = A,T,C or G
aaaaacctggnnctcgcgcgcctgcaggncgacactagtggatccaaagaattcggcacgagctggtggggagtattgaattcacagaattgatggaagctgtaatttactattctacagataaaagccctcttttgaatgtagataattcatctgtgttgtaacttctgtttcctaagttgagtctcccatttcattgtatcatttggatggaaggtggttttcactgagtagattgcttaggatgtgtaaggctatagcagtagaataaatgctattagtgatccccaagtattagctgtcttctgtgaaagttatgcagaccatctgcttctcctttcttagtttattgcctctaagccatttgcttctcacgtatttgcaaaggaatggaaagatg

SEQ ID NO: 10708 - DNA, 400 bp, Homo sapiens
  misc_feature 28, 177, 229, 230, 379: n = A,T,C or G
aaaacctggtgctcgcgcgcctgcaggncgacactagtggatccaaagaattcggcacgagcggctgctgttggttgggggccgtcccgctcctaaggcaggaagatggtggccgcaaagaagacgaaaaagtcgctggagtcgatcaactctaggctccaactcgttatgaaaagngggaagtacgtcctggggtacaagcagactctgaagatgatcagacaaggcnnagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgngcacacctggctatcattgat

SEQ ID NO: 10709 - DNA, 400 bp, Homo sapiens
  misc_feature 11, 35, 161, 339: n = A,T,C or G
aaacctggttntcgcgcgcctgcaggccgacactngtggatccaaagaattcggcacgaggtcgaatatcaaaaaatatttgttattgtttttattgttatttggggatttttcataaacaaactgacaactggggttggcctgattcatgagatattggnggagttctttgaaatgccccagttctcttaccttcagaagtccaaagctttccacagaatttctgccagttcccatggaggtttgcattttcacagtcccttctggcataatcatttgctgctgaattagttcacgttgcagatcgactcaccatccgtttatgtgtcattgtcttgnggcacagctcttccttaattacctagctcttccttaattactctcccctcctccaaaccct

SEQ ID NO: 10710 - DNA, 117 bp, Homo sapiens
  misc_feature 3, 17, 29, 32, 44, 52: n = A,T,C or G
tgnaggccgacactagnggatccaaaganttnggcacgagccancacaggangaggggatcctgccctcgggcagacggggcacggggagaggtcctgccaaataagctgtaggggc

SEQ ID NO: 10711 - DNA, 178 bp, Homo sapiens
  misc_feature 3, 17, 29, 67, 93, 111: n = A,T,C or G
tgnaggccgacactagnggatccaaaganttcggcacgaggttccttgacagctcgggtaactgcanaggccgagggtctagctgggtccagngctcacaggaacactggnttgcatctcccagccaggtttcctccgttttcgctttgctcttgggccagcgcttcctgagaggagg

SEQ ID NO: 10712 - DNA, 200 bp, Homo sapiens
  misc_feature 10, 54, 80: n = A,T,C or G
aaaaacctgnttctcgcgcgcctgcaggccgacactagtggatccaaagaattnggcacgagctaggagactacatgggngcctcctgtcacgcctgtatcgggggcaccaacgtgcgtgctgaggtgcagaaactgcagatggaagctccccacatcatcgtgggtacccctggccgtgtgtttgatatgcttaaccgg

SEQ ID NO: 10713 - DNA, 398 bp, Homo sapiens
  misc_feature 5, 7, 226, 377: n = A,T,C or G
cctgntnctcgcgcgcctgcaggccgacactagtggatccaaagaattcggcacgagcaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaanaggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagngtaatctcactgaacagtaat

SEQ ID NO: 10714 - DNA, 353 bp, Homo sapiens
  misc_feature 18: n = A,T,C or G
ctcgcgcgcctgcaggcncgacactagtggatccaaagtaattcggcacgagcggcacgaggatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccct

SEQ ID NO: 10715 - DNA, 258 bp, Homo sapiens
  misc_feature 122, 131, 188, 224: n = A,T,C or G
ctggtgctcgcgcgcctgcaggccgacactagtggatccaaagaattcggcacgagagttactgcaaggcctccattatccagttttattttttacacgattgaccttgccttgtagctggngctgtgtanacctgtgttgaaaacacaatcggaatatatgaataattgaataaacagcattatggngaggcagagacacatggagaagtgttaaaaaaaaanggggcttcctgcctttctgcctctttttttatgc

SEQ ID NO: 10716 - DNA, 100 bp, Homo sapiens
  misc_feature 5, 21, 33, 36, 68, 83: n = A,T,C or G
gcgcntgaggccgacactagnggatccaaaganttnggcacgagggcacccaccccaccaagggtcanagcagccacgcctanagggagccaccagggtc

SEQ ID NO: 10717 - DNA, 145 bp, Homo sapiens
  misc_feature 21, 22: n = A,T,C or G
cggcacgaggcggcagaatgnnggctaccagggtatttagcctagttggcaagcgagcaatttccacctctgtgtgtgtacgagctcatgaaagtgttgtgaagagcgaagacttttcgctcccagcttatatggatcggcgtga

SEQ ID NO: 10718 - DNA, 247 bp, Homo sapiens
cacgagcggcacgaggacttgcaaaaatacagaccgagaacaaggccatgtggagatagaggcagagactgaagttgtaccaccaaaggcaaagaatatcaagtattatcagtaaccacaggaagctggaagaggccaggaaaggtttttcttagagaccttggaaggagcctgaccctggaacaccttgaattttagacttctgaccctcaaaattgtgaaagaataaatttctgttgttttaagc

SEQ ID NO: 10719 - DNA, 385 bp, Homo sapiens
  misc_feature 10: n = A,T,C or G
aaacctggtnctcgcgcgcctgcaggccgacactagtggatccaaagaattcggcacgagtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcaggatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctg

SEQ ID NO: 10720 - DNA, 379 bp, Homo sapiens
  misc_feature 10, 28: n = A,T,C or G
aaaacctggntctcgcgcgcctgcaggncgacactagtggatccaaagaattcggcacgagcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttc

SEQ ID NO: 10721 - DNA, 128 bp, Homo sapiens
  misc_feature 2, 3, 30, 76, 123: n = A,T,C or G
gnngaagacccggaaacttaggggccacgngagccacggccacggccgcataggcaagcaccggaagcaccccggnggccggggaaatgctgggggtctgatcaccaccggatcaacttcganaaata

SEQ ID NO: 10722 - DNA, 227 bp, Homo sapiens
  misc_feature 65: n = A,T,C or G
tcgcgcgcctgcaggccgacactagtggatccaaagaattcggcacgagagaatttggacttgangaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgt

SEQ ID NO: 10723 - DNA, 278 bp, Homo sapiens
  misc_feature 11, 15, 39, 106, 108, 122, 225: n = A,T,C or G
aaaaagctggngctngcgcgcttgcaggtcgacactagnggatccaaagaattcggcacgagaaccagacgagctacctaagaacagctaaaagagcacacccgtntntgtagcaaaatagngggaagatttataggtagaggcgacaaacctaccgagcctggggatagctggttgtccaagatagaatcttagttcaactttaaatttgcccacagaaccctntaaatccccttgtaaatttaactgttagtccaaagaggaacagctctttggac

SEQ ID NO: 10724 - DNA, 400 bp, Homo sapiens
aaaaaagctggagctcgcgcgcctgcaggtcgacactagtggatccaaagaattcggcacgagcttctacccacttataataagcccagtaagctccttcttatccttcaaggtcaggtcaagtgtcacctcgggaagcattcttccttcatcaagtctgttaagtgctaaattgtttatgcttccattatagctcttattccctttgtagttagctatttaaatgccctgctctcacactgctggagccacattttatacaggtctgtgtcctcagcagctatcagcaagcacaaagcaattcctcatggaatgaatggatctttacaaaacccaaaagtacagtattaaaatcaagatttcatgggcagaggtaatgggtgagtataatggcttgaat

SEQ ID NO: 10725 - DNA, 400 bp, Homo sapiens
aaaagctggagctcgcgcgcctgaggtcgacactagtggatccaaagaattcggcacgagcattattgcagccctagcagcactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccacatcaagcccgaatgatatttcctattcgcctacacaattctccgatccgtccctaacaaactaggaggcgtccttgccctattactatccatcctcatc

SEQ ID NO: 10726 - DNA, 400 bp, Homo sapiens
  misc_feature 3, 14, 295, 334, 348, 349: n = A,T,C or G
aanaaactggaagnctcgcgcgcctgcaggtcgacactagtggatccaaagaattcggcacgagctggtgcaaagggtgttgctggtgaaaagggtagcacaggtgctccagggaagcctggtcagatgggaaattcaggcaaaccgggccaacaggggcctccaggagaggtgggaccccgaggaccccgggggcttcctggcagtagaggagaattaggaccagtgggatccccaggcctaccaggtaaactgggttctctgggtagccctggcctccctggcttgcctgggnccccctggacttcctggaatgaaaggtgacaggggtgtngtcggtgaaccggnnccaaagggtgaacagggtgccttctgtgaagaaggtgaagcaggagaaagg

SEQ ID NO: 10727 - DNA, 188 bp, Homo sapiens
  misc_feature 35: n = A,T,C or G
cgcgcgcctgcaggtcgacactagtggatccaaanaattcggcacgagaacatccagaaatccctggctggaagctcaggccccggggcctccagcggcaccagcggagaccacggtgagctcgtcgtccggattgccagtctggaagtggagaaccagagtctgcgtggggtggtacaaggagctgc

SEQ ID NO: 10728 - DNA, 400 bp, Homo sapiens
  misc_feature 2, 3, 58: n = A,T,C or G
annaaaaaaaagcctggagctcgcgcgccctgcgggtcgacactagtggatccaaagnaattcggcacgagggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaac

SEQ ID NO: 10729 - DNA, 400 bp, Homo sapiens
  misc_feature 5, 8, 28, 32, 37, 41, 82, 112, 146, 200, 203, 244, 312, 377: n = A,T,C or G
ctagnggnatccaaagaatttgggccgngcanatgtntacntaataagctaacgctcaaaagttgttaagtaaaataagttncagagtcattgaggtaatatattaaagctntatttcaggccagacttagttcagggaaccagantacaaatgcgaatatatcagtccttgctatcatgaagctaacgatcaagctggngcnatagtcacaaaagtagataacttcaatccaaaacatcaagngctattgggatggatgaagaaatgatggaaggatgcccagagtaaaccataagatgctatgtaaaagngggggatatggttcggatgtttatcccctccaaatctcatgttgaaatgtgattcccaatgttanaggtggggagaggtaggaggtga

SEQ ID NO: 10730 - DNA, 166 bp, Homo sapiens
  misc_feature 2, 14, 27, 46, 59, 64, 71, 98, 101, 107, 124, 140: n = A,T,C or G
cntgcccctgcggntcggacacttagnggatccaaagaattcggancgaggaaaaaaangtatnttctgtngatttggggtggagagttctgagatgnctnttaggnctgcttggggagagctnagttcaattcctgggnatccttgttgactttctgtctcgttg

SEQ ID NO: 10731 - DNA, 184 bp, Homo sapiens
  misc_feature 4, 9, 28, 58, 66, 125, 169: n = A,T,C or G
gctngcgcncctgcaggtcgacactagnggatccaaagaattcggcacgagctggagngctgcagnggcacgatctcggctcactgcaatctccgcctcctggtttcaagcaattctcctgtctnggcctctcaagtagctgggactacaggcacctgccaccatgcgnggctaatttttgtat

SEQ ID NO: 10732 - DNA, 398 bp, Homo sapiens
aaaagctggagctcgcgcgccctgcggtcgacactagtggatccaaagaattcggcacgaggaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaaagttgggggaagaggcagaaaatggaagagacgcccctgctaacgggaatgctaatgaggaaaatggggagcaggaggcttgacaatgaggtagacgaagaagagg

SEQ ID NO: 10733 - DNA, 400 bp, Homo sapiens
aaaagctggagctcgcgcgcctgcaggtcgacactagtggatccaaagaattcggcacgaggcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaaggattgcaggggttaccaggtgtaccttggaattcctggtgcaaag

SEQ ID NO: 10734 - DNA, 400 bp, Homo sapiens
  misc_feature 5, 19, 56, 213, 220, 231, 303, 312: n = A,T,C or G
cttgnggtcggacactagnggatccaaagaaattcggcacgagataacaccgtagngcaacacattactttttctatgtttaggtaagtttctatacacaaatacttaccactgttttgccgttgcctaacatattcagtacagtagcatactgtacaggtttgcaacaggctataccacaccgcctaggtatgtagtaggctgtaccatctnggttcgngtaagtaaatngtatgatgtttacacaatgagaaaatgttccatttcccagttcatatcctccttcttaagcaatgcatgagnatctcttcngttcttatgctttcctcttccaggaaatagatataaggttgggtcctagcaacaattttttgcttcacataatatctaaagatatcta

SEQ ID NO: 10735 - DNA, 399 bp, Homo sapiens
  misc_feature 30, 31, 40, 63, 85: n = A,T,C or G
tgggaacaataagactggtttttccgcgcnncttcgaggntccgacactagtggatccaaagnaattcggcacgaggtttttcangactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtg

SEQ ID NO: 10736 - DNA, 227 bp, Homo sapiens
  misc_feature 136, 198, 202: n = A,T,C or G
aagctggagctcgcgcgcctgcggtcgcactgtggatccaagaattcggcacgagctttgattattctttaatttttatttgagctgtttcaatagcataatgaaataaaattttgaattggccaataacatggcnttatatcttccagtgagagtctgatacaattactcttggccctgttggagtccctaacaaanagtnggtgtttgaacttacaggatttaag

SEQ ID NO: 10737 - DNA, 397 bp, Homo sapiens
  misc_feature 12, 19, 83, 229, 234: n = A,T,C or G
aaaagctggagntcgcgcncctgcggtcgacactagtggatccaaagaattcggcacgagcacaatgccaaggtcaaactggngatgtggcctctcagctcactgaggagatacggtcgggactcaacgtggttcacgtttgagtcaggaaggtaagatctagtgcagcagccaagtgcaggagttgtctgtataacagagtctgtataacagagtcctgaaagagagngctgnccatcattgcccccagtgagcactgttttcattcagggtaaaagttaccaaatacataatttcttcagattcttaataacatgaatacaattctgttagtttttttggcaggctaattaccccattcaaaataatttcagtttcttacactaccatcaaactc

SEQ ID NO: 10738 - DNA, 400 bp, Homo sapiens
  misc_feature 2, 184, 343, 346, 389: n = A,T,C or G
anaagctggagctcgcgcgcctgcaggtcgacactagtggatccaaagaattcggcacgagccaaggtgcaacttccttcggtcgtcccgaatccgggttcatccgacaccagccgcctccaccatgccgccgaagttcgaccccaacgagatcaaagtcgtatacctgaggtgcaccggaggngaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgagggnggngccttctgcctctgccctgatcatcaaagccctcaagggaccnccaagagacag

SEQ ID NO: 10739 - DNA, 400 bp, Homo sapiens
  misc_feature 4, 11, 38, 82, 96, 220, 252, 288, 329, 364: n = A,T,C or G
aagnctggagntcgcgcgccctgcaggtcgacactagnggatccaaagaattcggcacgagggcttccatttcagctatggngatgacaatctggntcccaacactgccaacgtccagatgaccttcctacgcctgctgtccacggaaggctcccagaacatcacctaccactgcaagaacagcattgcctatctggacgaagcagctggcaacctcaanaaggccctgctcatccagggctccaatgacgnggagatccgggcagagggcaatagcaggttcacgtncactgccctgaaggatggctgcacgaaacataccggtaagnggggcaagactgttatcgagtaccggtcacagaanacctcacgcctccccatcattgacattgcacccatg

SEQ ID NO: 10740 - DNA, 400 bp, Homo sapiens
aaagctggagctcgcgcgcctgcaggtcgacactagtggatccaaagaattcggcacgagggccacctagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccct

SEQ ID NO: 10741 - DNA, 400 bp, Homo sapiens
  misc_feature 3, 5, 321, 336, 337, 382, 389: n = A,T,C or G
aancnaaagactggagctcgcgcgcctgcaggtcgacactagtggatccaaagaattcggcacgaggcctggctcagggaagggcacccagtgtgagaagatcgtgcagaagtatggctacacccacctctccaccggggacctcctgcggtccgaggtcagctcaggctcggccaggggcaagaagctgtcggaaatcatgggagaaggggcagcctggttccacctggagacagtgttggacatgctccgggatgccattggtggccaaagtcaatacttccaaaggcttcctgattgatggctaccccgcgggagggngcaggcaaggagaannagtttgagcgaccggattggacagcccacacctgctgcttgtatntggaccncaggcccctgg

SEQ ID NO: 10742 - DNA, 400 bp, Homo sapiens
  misc_feature 6, 220, 387: n = A,T,C or G
cgcgcncctgcaggtcgacactagtggatccaaagaattcggcacgaggcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcgcgnctagttacctaccggagagttatcctgataaattaacctctcacagttagtgatcctgtccttttaacaccttttttgtggggttctctctgacccttcatcgtaaagtgctggggaccttaagtgatttgcctgtaattttggatgattaaaaaatgtgtatatantattagctaatta

SEQ ID NO: 10743 - DNA, 100 bp, Homo sapiens
  misc_feature 15, 17, 34, 78, 83, 93: n = A,T,C or G
aaaagctggagcttngngcgcttgaggtcgacantagtggatccaaagaattcggcacgagctcgtgccgatttcggnacganctacaagtanttggaac

SEQ ID NO: 10744 - DNA, 400 bp, Homo sapiens
  misc_feature 2, 23, 29: n = A,T,C or G
cntaagactggagctcgcgcgcntgcggncgacactagtggatccaaagaattcggcacgagtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaaagatggcagaaaaaaaagtctt

SEQ ID NO: 10745 - DNA, 400 bp, Homo sapiens
  misc_feature 4, 17, 31: n = A,T,C or G
aaantaaagactggagntcgccgcgccctgnaggtcgacactagtggatccaaagtaattcggcacgagtggcagtcagcagttttctgtcccaggttttactgccgaagggaaagaaccgaggtttatacaaagatctgtctgaccctcaagtctccaagtctctgccattaactgctctgctttgcggttcttacccaagatcccacaactgatgcttggttaagtcaactcaagcgcttagacactgtgggtgcttcatggagcttactgaaaacaaagtgagtcatggataggagtttgacattgaacacttgagccatacatccattttttgagaacaggggtggcctttcctggcgccctgcacccatccaggcaagctgtgggtggtaggtgt

SEQ ID NO: 10746 - DNA, 125 bp, Homo sapiens
  misc_feature 9, 18, 59, 60, 75, 83, 89, 94, 103, 106, 121: n = A,T,C or G
tgaaggtgngacactagnggatccaaagaaattcggcacgagcggacatctgttactgnntacctgtatactgtntacctgtnacattnaaagngattgtcanggntcctagaagtctgtntttt

SEQ ID NO: 10747 - DNA, 122 bp, Homo sapiens
  misc_feature 2, 3, 77, 78, 108, 109, 117: n = A,T,C or G
cnnaagactggagctccgcgccgcctgcaggtcgacactagtggatccaaagaaattcggcacgagctcgtgccgannctcctggattcattaattttttaaggggtnnttgtgtcnctatt

SEQ ID NO: 10748 - DNA, 400 bp, Homo sapiens
  misc_feature 11, 24, 256, 274, 283, 295, 346: n = A,T,C or G
cttcttttaancgaaagactggtntctcgcgcgcctgcaggtcgacactagtggatccaaagaattcggcacgagctcgtgccgaattcggcacgagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcanaattgttatcactctggngcatgctgncacaggggccgntgcgtttggctttgtggagggcctggacccttccacaagaacacccgaggntccagggcacttcaggacaattgttttccaagggaacgaggtcgaccaggaaag

SEQ ID NO: 10749 - DNA, 250 bp, Homo sapiens
  misc_feature 1, 59, 81: n = A,T,C or G
ngcgcgcctgcaggtcgacactagtggatccaaagaattcggcacgagctcgtgccganttcggcacgagctgcagcagcnttccttccatgattatcaaggttcatgcaactgatctgtttcattgcatgtatttgaatgtctctttccttcctctacacttctagaattaatttgttggttaaggaagataactcagctagaggaatcaggggggttttttaatatgagactctgcaaatacatttct

SEQ ID NO: 10750 - DNA, 400 bp, Homo sapiens
  misc_feature 2, 9, 105, 175, 356, 393: n = A,T,C or G
angactggngctcgcgcgcctgcaggtcgacactagtggatccaaagaattcggcacgagcattgacggatccaagagtgtgaggccagagaactttgagctggngaagaagttcatcagtcagatcgtggatacgctggacgtgtcaagacaagctggcccaggtggggctggngcagtactcaagctctgtgcgccaggagttccccctgggtcgcttccacaccaagaaggacatcaaggcggctgtgcggaatatgtcctacatggagaagggcacaatgactggggctgctctcaagtacctcattgacaattccttcactgtgtccagtggggctaggccccgggcccanaagggggggcatttgtctttcacttgatggcccgganccaggac

SEQ ID NO: 10751 - DNA, 399 bp, Homo sapiens
  misc_feature 10, 38, 218, 392: n = A,T,C or G
ctcgcgcgcntgcaggtcgacactagtggatccaaagnaattcggcacgagatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgnttccaatctctctctccctgatcggtgacagtcactagcttatcttgaacagatatttaattttgctaacactcagctctgcccctccccgatcccctggctccccagcacacattcctttgaaataaggtttcaatatacatctacatactatatatatatttggcaacttgnatttggg

SEQ ID NO: 10752 - DNA, 399 bp, Homo sapiens
  misc_feature 2: n = A,T,C or G
ancgaaagctggagctcgcgcgcctgcaggtcgacactagtggatccaaagaattcggcacgagaaagtataaacaaggtattctaaatataaggcagtaatttttcttcttcattattaaattctctggtcaaagaagttcctacaactgaagtggaaaagccttcactaaattgtaaactgtctggttgctgttagtgtgagccatagggtgaagagcagcatggtgcctctgatgcagtgaacctcaaatgacaccacattgaaggcccagcaatcaggcttacattcaaatatgtactcactttatctcttctgaaaagaaaaccaggccaggcacggtggctcatgcctgtaatcccagaactttaggaggctgaggcggggccggatcaccct

SEQ ID NO: 10753 - DNA, 400 bp, Homo sapiens
  misc_feature 2, 13: n = A,T,C or G
cnaaagctggttnttcgcgcgcctgcaggtcgacactagtggatccaaagaattcggcacgagggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtaccgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccg

SEQ ID NO: 10754 - DNA, 386 bp, Homo sapiens
  misc_feature 53, 144, 302, 332, 337, 346, 365: n = A,T,C or G
accgaaagctggagctcgcgcgcctgcaggtcgacactagtggatccaaaganttcggcacgagctcgtgccgaattcggcacgagaagacgcatgttatggggctaatgtactttcacttttaaactctagatcagaattgtngacttgcattcagaacataaatgcacaaaatctgtacatgtctcccatcagaaagattcattggcatgccccaggggattctcctccttcatcctgtaaagggcaacaataaaaaccaaattatggggctgcttttgtcacactagcatagagaatgngttgaaatttaactttgtaagcttgtatgnggggntgttgatcnttttttttccttacagacncccataataaaatatcatatt

SEQ ID NO: 10755 - DNA, 400 bp, Homo sapiens
  misc_feature 3, 10, 31, 393: n = A,T,C or G
gcntgcaggncgacactagtggatccaaagnaattcggcacgagattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggngtgcata

SEQ ID NO: 10756 - DNA, 398 bp, Homo sapiens
  misc_feature 2, 7: n = A,T,C or G
ancgaancctggtgctcgcgcgcctgcaggtcgacactagtggatccaaagaattcggcacgagggactacttcatatgaactacatttctaatgagaacagagtccaatgaacagaaaaagaaatatcattatatatggaagggcaatgtcacatttctaacgattctgttacgttgagatattcagggatcaaacctagtagggttcagccctgtaatggggcttaacatttagaacaatttaaaaatattaaaacttagatgaagttataaaagatgttacagatgagaaaaagatgaaaatgagtattaatatgatggatgggaaaggccatacacaaagttaatctgctgagttgatgggttgcatcaaaattatgggactgaatttaaatgt

SEQ ID NO: 10757 - DNA, 400 bp, Homo sapiens
  misc_feature 7, 24, 108, 179, 212, 214, 313, 332, 344, 356, 382, 389: n = A,T,C or G
gcgcgcntgcaggtcgacactagnggatccaaagaattcggcacgagaaactgagaggtataccatgttcatggatctgaaaattcagtattgttaagatgccagttnttgccaaattgatcaacagatttaaaacaatcctcatcaaaacctcaggagaggacatttttgtacaaatnggcgtatgattctaaaattcatatggaaatgcngnggacctaggataaccaaaacaactttgaaaatgaacaaggctggagaacttaaagcacctgacttcaagatttacaaagctacagtaatcgagatgggngatatttggggtcaagatngagattatgaancataagaaagantccagaaaataatctccacatatctngtaaatngactctcaaga

SEQ ID NO: 10758 - DNA, 100 bp, Homo sapiens
  misc_feature 11, 12, 38, 68, 72, 87: n = A,T,C or G
aaacctggttnntcgcgcgcctgcaggtcgacactagnggatccaaaaaattcggcacgagcaacacntgcnttttggactttgggnacttaaaagcgtg

SEQ ID NO: 10759 - DNA, 323 bp, Homo sapiens
  misc_feature 224: n = A,T,C or G
tacccatgtagcagcaacttgaacgaatgtcacaacttgtacgttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagttcttctgatgccaatctcaacattgtctttttaatactgncaccagatattgccatttttctttttgttaaaagattatatgatcaagataaattggggtggtaaatcaggtgcctggtaatttatctctttgcacatg

SEQ ID NO: 10760 - DNA, 102 bp, Homo sapiens
  misc_feature 10, 16, 27, 44, 45: n = A,T,C or G
gcttgcgggncggcantaggggattcnaggaattcgggaagagnntatgaggcttagttgtaacaagctacctcggcctatgagaacacagacctaaaaacg

SEQ ID NO: 10761 - DNA, 333 bp, Homo sapiens
  misc_feature 313: n = A,T,C or G
gaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcnacaagacccactgggcagtg

SEQ ID NO: 10762 - DNA, 336 bp, Homo sapiens
ctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccag

SEQ ID NO: 10763 - DNA, 100 bp, Homo sapiens
  misc_feature 5, 7, 8, 10, 15, 16, 20, 24, 71: n = A,T,C or G
aaagngnntnctggnnttangcanttaacccaggcactggggcgctgaacagctactcagctgcttaagtngtcccactggtccagaccagcgacccagc

SEQ ID NO: 10764 - DNA, 102 bp, Homo sapiens
  misc_feature 67: n = A,T,C or G
cgggcgacactgccaaactgcaaaaagttttcgaattctactcgcctgatagaggtgctaatatccngattttccgatgatctcatgcacatttacaagata

SEQ ID NO: 10765 - DNA, 208 bp, Homo sapiens
  misc_feature 12: n = A,T,C or G
ctacttggctgngggcaccagcagtgctgaggtgcagctatgggatgtgcagcagcagaaacggtttcaaaatatgaccagtcactctgcccgagtgggctccctaagctggaacagctatatcctgtccagtggttcacgttctggccacatccaccaccatgatgttcgggtagcacaacaccatgtggccacactgagtggccac

SEQ ID NO: 10766 - DNA, 103 bp, Homo sapiens
  misc_feature 10, 16, 55, 92: n = A,T,C or G
gcctcagggngccatnaaaggttactttttttatctggggagcgacaagatcacncatgcacatttgagagtttactggctttgcggataangggctggacag

SEQ ID NO: 10767 - DNA, 100 bp, Homo sapiens
  misc_feature 3, 16, 51, 64, 70, 80: n = A,T,C or G
acnaggcaatgggggnttgcattttagctttggagatgacaatatggctcncagcattgccaangtgcanatgaccttantacccctgttggccagggga

SEQ ID NO: 10768 - DNA, 334 bp, Homo sapiens
cacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctac

SEQ ID NO: 10769 - DNA, 101 bp, Homo sapiens
  misc_feature 4, 21, 28, 37, 38, 40, 44, 49, 55, 64, 66, 67, 71, 77, 80,83: n = A,T,C or G
atgngctgaatcagggcctcncctcgcntactttatnngnacancaagntaactngcctattgnannactntctggntgnctnagccccacaatatccctt

SEQ ID NO: 10770 - DNA, 100 bp, Homo sapiens
aaatggagacatgaaactgtgaccctggaaccgtagaacggaacacaggtccatgggaccatcacacgtgcgcatgtgagcatgaatacacatcttcacg

SEQ ID NO: 10771 - DNA, 213 bp, Homo sapiens
  misc_feature 26, 125, 132, 161: n = A,T,C or G
ccaaggtgcaaccttccttcggtcgncccgaatccgggttcatccgacaccagccgcctccaccatgccgccgaagttcgaccccaacgagatcaaagtcgtatacctgaggtgcaccggagganaagtcgntgccactttctgccctggcccccaagatnggccccctgggtcttgtctccaaaaaaagttggagatgacattgccaaggca

SEQ ID NO: 10772 - DNA, 100 bp, Homo sapiens
  misc_feature 2, 9, 11: n = A,T,C or G
cnttatggnantggggcggagatatgctcatgtgctgatgaggaaagcagacattgacctctccaacaggccgggagaactcactcactatgtggggaaa

SEQ ID NO: 10773 - DNA, 400 bp, Homo sapiens
gacaaaagctggagctcgcgcgcctgaggtcgcactagtggatccaagaattcggacgagactatctgcttggtgaatccctgttcatcttttaaaaccacttcatactttacctccttcaggaagcttctcccctgtctcctctcccccctatatagagttgattattcccctgtctgtctttggcatgcatcttttttttatgttgcattacaccttgttcatttttttttctcgatatgggctcacttctgttgcccaggctgtagtgcattgggcatgatcacggttcattgcagcctcagcctcccaagtatctgggaccacaggcatgtgccaccactcctggctaatttttttatttttatttttgggaagagatagggtctcactatgtggc

SEQ ID NO: 10774 - DNA, 306 bp, Homo sapiens
  misc_feature 170, 192, 253, 276: n = A,T,C or G
ttcggcacgaggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgntgggcttaccttcctgcttcgngaccttcctcctgccagcgggctggatcctgtcacacctggagacctacaggaggcagagngaaggggtccgttctgtccctanactgggacctgaccagccccaccggcccat

SEQ ID NO: 10775 - DNA, 100 bp, Homo sapiens
  misc_feature 8, 13, 36: n = A,T,C or G
taggggantcaangaattcgggacgagggtgaccgnagaagcagacggggagaccactctccctctcagactcttatgcgcttgtgcgtgtgtatgggga

SEQ ID NO: 10776 - DNA, 103 bp, Homo sapiens
  misc_feature 28, 40, 43, 48, 53, 56, 71, 73, 80, 92: n = A,T,C or G
gtgctctcttgcgctacatgggtaccangacaccgcagancanaaatntaaanacntagagacgctgtgancnggcctancgcgctatcganatgactaaata

SEQ ID NO: 10777 - DNA, 259 bp, Homo sapiens
  misc_feature 177, 188, 225: n = A,T,C or G
caagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttnagttccagctnaggctcccaaacgtacccaggcccctacaaaggcttnagagtagatatctctgccaacatgaggacagaag

SEQ ID NO: 10778 - DNA, 324 bp, Homo sapiens
  misc_feature 152, 167, 194, 221, 229, 295, 298: n = A,T,C or G
ttcggcacgagtgaaagagacttccagcttcctcctcctcctcttcctcctcctcctcctgccccagcgagccttctgctgagctacaccaatgggaatcccaatggggaagtcgatgctggtgcttctcaccttcttggccttcgcctcgngctgcattgcttgcntaccgccccagtgagaccctgtgcggnggggagcctggtggacaccctcccagntcgtctgnggggaccgcggcttctacttcagacttccaggcaggcccgcaagccgtgtgagccgtcgcagccgnggnatcgttgaggagtgctgtttccgcag

SEQ ID NO: 10779 - DNA, 292 bp, Homo sapiens
acctcaagaaagcaacgaaaggaacgcaagaacagaatgaagaaagtcagggggactgcaaaggccaatgttggtgctggcaaaaagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaaga

SEQ ID NO: 10780 - DNA, 100 bp, Homo sapiens
gctgaggggccaggaggggcataagacagaaacccgccctcctgacctcaggagatcatgcatagagggtgatggaggggtgatagatatgttacacaca

SEQ ID NO: 10781 - DNA, 102 bp, Homo sapiens
  misc_feature 3, 6, 87, 90: n = A,T,C or G
ctnggntgctttcctttgaaccttggaatctcgtgaatggagggctgcctttccctcccctccttcccttttttgttcctgggaaanggnaaactccgaaag

SEQ ID NO: 10782 - DNA, 335 bp, Homo sapiens
aaagaattgaagccccttcttaccacattgacctcatcttacgccattgtcttttctcacttctatgctgtagccacaccagctgtttctattcctgaaaccgggtctctgtaattgctgttccctttgactggagtgcttttcccccatggtcttctcatggctggcgtcttctctgcaggtctttgctgattctacctcttcaaagaggctttcgctggttgtccttactcataacgtagatcccactcctccaccgtcattccctgtatcattaccctgcttcatgtttcccccaagtgttgatgggtgtctgagatctgatgcttatttgg

SEQ ID NO: 10783 - DNA, 325 bp, Homo sapiens
agacttttcctgctgagtccagcactgcaactgtgcctctgctgaaagaaacttcccaacagcagaaagacctgtatgataggtagggataatttcggtcttctgcatatggttagccagtgttctcagcactctttattgaataagggatgcttttctcatgaaaaatacataatttaaatgattcaaagagaaataagaaatggatgccacttaattatgggaaactttatgtttaaaagcacagggaaagtgcattaaagatgccatattcatttatattattatttgggagcatgtaagaacattagataaataagaaggg

SEQ ID NO: 10784 - DNA, 105 bp, Homo sapiens
  misc_feature 8, 12, 29, 34, 44, 54, 59, 60, 67, 73, 81, 85, 87, 89, 91,98, 99, 102: n = A,T,C or G
aaaaggcngaanatctggagcttgcgggncggantaggggattnaaagaattanagaanngggcgcnagggcngtacgggngtancncngnggttagnnttnagg

SEQ ID NO: 10785 - DNA, 100 bp, Homo sapiens
  misc_feature 14, 16, 34, 73, 76, 83: n = A,T,C or G
taatacttaccgantnacactttgagaccatttnattatagggtcttgggtgcctgggtgcttccccacgtgnccnggaggcnggcaaagggaaaaaaca

SEQ ID NO: 10786 - DNA, 400 bp, Homo sapiens
  misc_feature 22: n = A,T,C or G
gacaaaagctggagctcgcgcncttgaggtcgcactagtggatccaaagaattcggacgaggagaactactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgtt

SEQ ID NO: 10787 - DNA, 120 bp, Homo sapiens
  misc_feature 21, 40, 43, 51, 57, 62, 69, 87, 116: n = A,T,C or G
ctgcttaccagatcattagantgtcgttctgaaggtaaantcntaacaacngacacnccgcnattttgngtattagacctcttgagntaagaagggcagaccttcttaaacctaantacc

SEQ ID NO: 10788 - DNA, 336 bp, Homo sapiens
atgccgataggacatccatgcaaattagcttcctgcacagggcagaattttatcagattattctgagtaccaaatttcatgaaggtttttgaacattgggtaatttagttaaaaataatgtgtgccctgcttttgaagcataatagacaagctcagactgatcttctaaacccatcccttacgtgatggctggtaccttttcacagaactctgagaacggctatttaaattgatgactacctcccactccccaaccagagccctgtgtgttgaatcactgatgattccgctttgttctttaggattgacctgcaaggacaaatgcactttataatg

SEQ ID NO: 10789 - DNA, 325 bp, Homo sapiens
ttcggcacgaggagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagc

SEQ ID NO: 10790 - DNA, 337 bp, Homo sapiens
  misc_feature 335: n = A,T,C or G
tctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcanag

SEQ ID NO: 10791 - DNA, 340 bp, Homo sapiens
  misc_feature 215: n = A,T,C or G
caacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagcctcactgatttcatcctcaagtttccgcacagtgcccaccanaagtatgtccgacaagcctggcagaaggcagacatcaatacaaaatgggcagccacacgatgggccaagaagattgaagccagagaaaggaaagccaagatgacagattttgatcgttttaaagt

SEQ ID NO: 10792 - DNA, 324 bp, Homo sapiens
ctccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcatta

SEQ ID NO: 10793 - DNA, 397 bp, Homo sapiens
  misc_feature 12, 17, 35, 61, 239, 241, 354: n = A,T,C or G
gaaaaaaaaccnggatnttgcgcgcctgcaggtcnccactagtggatccaaagaattcggntcgagtcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggngngggtgacatggtgatggccacagtcaagaaaggcaaaccagagctcagaaaaaaggtacatccagcagtggtcatttcgacaacgaaagtcatacccgtagaaaagatggcgngtttctttattttgaagataatgcaggagtcatagtgaacaat

SEQ ID NO: 10794 - DNA, 400 bp, Homo sapiens
  misc_feature 28, 40, 63, 70, 72, 323, 326: n = A,T,C or G
ctttttgggaacaaaaaccctggttttngcgcgcctgcangtccacactagtggatccaaagnaattcgntncgagcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggnggngctgaccaggaattctttgtggacattggcccagtctgtttcaaataaatgaactcaatctaaattaaaaaaga

SEQ ID NO: 10795 - DNA, 336 bp, Homo sapiens
  misc_feature 310: n = A,T,C or G
aaattacttctgttttatagctgtaccttctaaacccatcataaggagggctctgtcagcacttctattacattctttactttacagaggtttataacatagtcataaaactcactctacgattagttttggcagataaactctcatctaggggaggaaggtgttgttttttccaacaatttaaaaagaccatactggcttgcctgttctcacacaactggagttcatagactcatttttgctacaaaacctttctttgggttttgtaaaagaggatgccctaattagccttcatatatttgggcattanaacctctcttttctccccaggaagga

SEQ ID NO: 10796 - DNA, 392 bp, Homo sapiens
  misc_feature 14, 22, 38, 57, 63, 64, 66: n = A,T,C or G
gggaaaaaaaaccnggtttttngcgcgcctgcaggtcnacactagtggatccaaagnaattcnntncgagcgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccag

SEQ ID NO: 10797 - DNA, 398 bp, Homo sapiens
  misc_feature 16, 20, 30, 37, 61: n = A,T,C or G
gggaaaaaacccggtntttngcgcgcctgnaggtccncactagtggatccaaagaattcgnttcgagagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggc

SEQ ID NO: 10798 - DNA, 400 bp, Homo sapiens
  misc_feature 3, 16, 59, 395: n = A,T,C or G
aanaacctggagtttngcgcgcctgcaggtccacactagtggatccaaagaattcggtncgagccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacattacctaccactgcaagaacagcattgcatacatggatgaggagactggcaacctgaaaaaggctgtcattctacagggctctaatgatgttgaacttgttgctgagggcaacagcaggttcacttacactgttcttgtanatggc

SEQ ID NO: 10799 - DNA, 337 bp, Homo sapiens
ccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtg

SEQ ID NO: 10800 - DNA, 400 bp, Homo sapiens
  misc_feature 5, 24, 30, 39, 69, 71, 95, 96, 246, 247, 300: n = A,T,C or G
ccctntgggaaaaaaacccgagtnttgtgngcctgcagnagccccactagtggatccaaagaattcggntngaggactcctcatcttaatctgannggaaggatgaggaagaagctgagagcaaaaccacctctctggagtgctggcagttggctctgcaccccaggaccctggcatggaagagggaccaccagactggccagggacagcttccaccagccctgactggcctcctttcccttcagnnctcagagcccatttggcctcaggaattccttcctccttccagaagtggatgcntcatcacagaagctccaggagtgctgacacttggcgctccatggggcccctgagctggtgagggcacccttcacaagtgtgcatatgaagtgtgccaaca

SEQ ID NO: 10801 - DNA, 400 bp, Homo sapiens
  misc_feature 14, 56, 232, 304: n = A,T,C or G
aaacctggagtttngcgcgcctgcaggtcccactagtggatccaaagaattcggtncgagggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggntcctgctttcacagaattattccagggtttatgtgtcagggtggtgacttcacacgccataatggcactggnggcaagtccatctatggggagaaatttgaagatgagaacttcatcctaaagcatacgggacctggcatcttgtccatggcaaatgctggacccaac

SEQ ID NO: 10802 - DNA, 400 bp, Homo sapiens
  misc_feature 23, 63: n = A,T,C or G
cttttgggaaaaaaccggatttngcgcgcctgcaggtcccactagtggatccaaagaattcgnttcgagggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagggacagctgccatgggcaaggaagaagatcgccaagagatcaaagataaaatcttttgtgaaagtgtataactacaatcacctaatgcccacaaggtactctgtggatatccccttggacaaaactgtcgtcaataaggatgtcttcagagatcctgc

SEQ ID NO: 10803 - DNA, 336 bp, Homo sapiens
ggcggatcggtgagatgcgtctggaaattttcttcgttcgcagtccccgtattaaaaacggaaagaaccgacccacgacaaacacgaccagagcgtaccgtgcccacgcgtgtcatcacagcactccgggaggccgatgcgggaggatctctggagcctaaaagttcgagatcacctcgacacgtgagatgacgcctacaataataataatcatagaagtttgaaaagagaccacgtgtgcccagagcatggacaataaagcgagagcacatccgtactaaaaagaagacgattgataggcaggcaggcaggcaggcaggcaggcaggcaggcagg

SEQ ID NO: 10804 - DNA, 338 bp, Homo sapiens
  misc_feature 176, 196: n = A,T,C or G
ggatcacatactacaaaaagtctcataattttttccagttcatattatcttggatatttccccatatttgtagtacaaatctgcctcgtcatttttaatgactgcataggattctgtttatatatgtgttattttttttagccagtcccttgttgatggacatctagatttccagngttttgatattaaaaacagngctgcacttaatatccttgtacacatcttttacacacctcttgtataatttattagaagtagaaatgatgggttgaaaatatatgcatttaatgtttgtttagatattaccaaatttcccccttaaaaaagacctaccaatt

SEQ ID NO: 10805 - DNA, 338 bp, Homo sapiens
tcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgc

SEQ ID NO: 10806 - DNA, 394 bp, Homo sapiens
  misc_feature 10, 12, 25, 27, 39, 40, 88, 387: n = A,T,C or G
gggtaacaananccctggagttttngngcgcctgcaggnnccacactagtggatccaaagaattcggtacgagcccaccttcaacagnggggatcacatttcagtgtgagatttggagggacacaaatctaaaccatatcagacattgagaaagatggactcaagtgtaggtagcagttactgagcacttcttacaagcccgacagtttattaattagcttgtgtaatctttacaacaacactgcgagctagtatggaatagatggtatcctcctcctcactgtacagatgaagagatgagacttggaagctttaaatgctttgcccaaggtcacctagttagtgagtgaccatggtgggatatgaactgtaattgcagaatccatnctttcat

SEQ ID NO: 10807 - DNA, 337 bp, Homo sapiens
agaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtg

SEQ ID NO: 10808 - DNA, 393 bp, Homo sapiens
  misc_feature 5, 22, 38, 64, 282: n = A,T,C or G
ggaanaaaaagcccggagtttngcgcgcctgcaggtcnccactagtggatccaaagaattcggntcgagattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgngctgtaaaataagaactagctgaagagacaaccaaagaagcattaaggcaggttgatgctgatgggaccataaaatatttttacactcaacctgagcggttattcttgaca

SEQ ID NO: 10809 - DNA, 109 bp, Homo sapiens
  misc_feature 35, 76, 81, 86, 89, 99: n = A,T,C or G
gcgcatcctgcagggcttctcctcctctgtctttnggagaaccagggctcttctcaggggctctagggactgccangctgnttcanccnggaaggccanaatcaagagt

SEQ ID NO: 10810 - DNA, 339 bp, Homo sapiens
gaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggc

SEQ ID NO: 10811 - DNA, 329 bp, Homo sapiens
  misc_feature 243, 251: n = A,T,C or G
acctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtnttagaggngggatgcagatcttcgtgaagaccctgactggtaagaccatcactctcgaagtggagccgagtgacaccattgagaat

SEQ ID NO: 10812 - DNA, 400 bp, Homo sapiens
  misc_feature 4, 43, 69, 208, 248: n = A,T,C or G
cacntttggaacaaaaagccggagtttgcgcgcctgcaggtcnccactagtggatccaaagaattcggntcgagaaagggcagtggcatgatctcggctcactgcaacctccgcctcctgggctcaagccatcttccttagcctcccaagtagctagaactacaggtgtgtaccaacacgtatggctaatttgttttgttttttttgngtgtgtggagacagggttttgccatgttgcccaggttggnctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtg

SEQ ID NO: 10813 - DNA, 400 bp, Homo sapiens
  misc_feature 15, 23, 28, 30, 45, 249, 250: n = A,T,C or G
ctttttgggaacaanaacctggnttttngngcgcctgcaggtccncactagtggatccaaagaattcgtttcgagcaattattaaaaaatacacccaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccnnggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctca

SEQ ID NO: 10814 - DNA, 394 bp, Homo sapiens
  misc_feature 8, 13, 22, 36, 61, 87, 170: n = A,T,C or G
gggacaanaaccngggttttgngcgcctgcaggtcnccactagtggatccaaagaattcgnttcgagcttttttgccttactgcttnggtataaggatgaaaaacatgagcactctgcagacaaaatgaccttaaatcacattgattaagatattttaaaagttagcagngaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcata

SEQ ID NO: 10815 - DNA, 400 bp, Homo sapiens
  misc_feature 2, 4, 43, 69: n = A,T,C or G
antnttgggaacaaaaacctggttttcgcgcgcctgcaggtcnacactagtggatccaaagaattcgtnacgagcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggctgggctggtggagttggcacgagatgtcagaggaacctgagtcatgctcaggcccaagccctgttggcaggcagaccac

SEQ ID NO: 10816 - DNA, 222 bp, Homo sapiens
  misc_feature 5, 24, 27, 29, 37, 41, 67, 68, 156, 157, 160, 163: n = A,T,C or G
ccctntgggaaaaaaaccctggtnttngngcgcctgnaggnccgacactagtggatccaaagaattnnttacgaggatcgccatcatgaacgacaccgtaactatccgcactagaaagttcatgaccaaccgactacttcagaggaaacaaagggnnatngangtccttcaccccgggaaggcgacagggccttaaaacagaaattcgggaaaaactagcca

SEQ ID NO: 10817 - DNA, 340 bp, Homo sapiens
acccccacctcaaggtcaggatgcgaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggttt

SEQ ID NO: 10818 - DNA, 400 bp, Homo sapiens
  misc_feature 28, 39, 67, 315, 366, 368, 372: n = A,T,C or G
accttttggacaaaacccggttttttgngcgcctgcagnaacccactagtggatccaaagaattcgnttcgagcctgctcggggccccgaacgctcccgccagcgcttccgaggcttccgctacccggaggctgcgggcccccgcgaggcgttgagccggctccgagaactctgcggacaatggctgcagcctgagatgcacagcaaggagcagatcctggagctgctggtgctggagcagttcctgaccatcctgccggggaatctgcagagctgggtgcgggagcaccatccaaaaagcggggaggaggtggnggtgctattggagtatttggagaggcagctggatgacccggccccgaaggnanaaanaacaggtttaagaatctgagcgctgggg

SEQ ID NO: 10819 - DNA, 202 bp, Homo sapiens
  misc_feature 13, 16, 34, 40, 41, 140: n = A,T,C or G
ggcgcctgcaggnccncactagtggatccaaagnaattcnnttcgaggaagaacggtgctattcagcaagttctctttcctttcccttggagggaagacagcagagtcatcagttaaaaaaaaaaaaagaaaaccaaacncctcccttgaacaaatttatactcctgttcccaggatcttgagctttagggggctataccta

SEQ ID NO: 10820 - DNA, 142 bp, Homo sapiens
gtttgcacctgtccccaccctccactcagctgtcctgcagcaaacactccaccctccaccttccattttcccccactactgcagcacctccaggcctgttgctatagagcctacctgtatgtcaataaacaacagctgaagc

SEQ ID NO: 10821 - DNA, 320 bp, Homo sapiens
ggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaaggctagatccccggtggttttgtg

SEQ ID NO: 10822 - DNA, 338 bp, Homo sapiens
cttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttt

SEQ ID NO: 10823 - DNA, 395 bp, Homo sapiens
  misc_feature 22, 24, 33, 36, 61, 63: n = A,T,C or G
gggaaacctatcctgagttttntnacaattcantgnccgctagtggatccaaagaattcgntncgagccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggcttgctgcaggccctgaccaggaaactggaagctgtgag

SEQ ID NO: 10824 - DNA, 329 bp, Homo sapiens
ccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcacc

SEQ ID NO: 10825 - DNA, 398 bp, Homo sapiens
  misc_feature 12, 17, 30, 38, 39, 247: n = A,T,C or G
tgggggaacaanaaccnggagttttgtgcncctgcagnncccactagtggatccaaagaattcggtcgagttaaactcctgacctcacaatccacccgcctcagcctccctatctctgtatcttatgaagacttcctttttctttctgaagagctgccataagtcttaaacatttaaatcatcagaaccttttcttgtagcagaaatgtgaatgttttcttgaagtacaggttacggttttcatggnacaagtgcttacctacgacgataagagaacaaggcttaaaatatccctcaaaagaacaattgtgagaattccatgttagcggctgtctttaaacgactaccctcaggcagatctgggtttttatatctttatcttcattcagggaagcaag

SEQ ID NO: 10826 - DNA, 322 bp, Homo sapiens
  misc_feature 1, 2, 19, 21, 44, 56, 77, 81, 85, 97, 117, 135, 223, 252,292, 314: n = A,T,C or G
nnggaccctgcccacctgngntcccaataaagaaaaacctcccnttctgaggctgntttcccaaaactccccctgcntctntatntcttcatctatnccacctcttgactgaacatnccacctttatcctgtgtnctgcctttgtttgaattttaactcatgctcatcctgcaacagaagcattctctaggtcccagtttccagttgattgcatatccttgancagccctttttcccatcctgccctatggntctctagccacctgtgcatgcatgcgtatttctgcctggntctatggtgtgaggatgtgtgngcatgaat

SEQ ID NO: 10827 - DNA, 340 bp, Homo sapiens
gtacttcttgtatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctga

SEQ ID NO: 10828 - DNA, 353 bp, Homo sapiens
gtgatgtggcagatcttatgtattggaggtagggggaaagaagatgcagtgtggaatagatgacaaggcccaatgagagaatcacagtgcaggtccctggggccctgaaggaaggtggttctaaccacaggagaggatcatatgctttttgaaaaacagcctctgctgtgctactgggccctggtagacacggaactttgagacccagtgatgctgtatccagaactgctcatcttaactaggtcctgtgggaagcactaagtcataagctagtaggatcggcagcagcccatttggaagatggaaatgatatgtacaggagcagttccaagccagaccagaggacataagca

SEQ ID NO: 10829 - DNA, 400 bp, Homo sapiens
  misc_feature 2, 30, 31, 67: n = A,T,C or G
anctttgggaaaataacccgagttttgtgnncctgcagggcccactagtggatccaaagaattcggntcgagctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggcttgtgtgcccgaggcctcaccctgccctcgcctagtctggaagctccgaccgacatcacggagcagccttcaagcattccattacgccccatctcgctctgtgc

SEQ ID NO: 10830 - DNA, 190 bp, Homo sapiens
  misc_feature 6, 7, 31, 32, 34, 51, 57, 61, 188: n = A,T,C or G
aaaacnncactaggggatccaaagaattttnntnggggggtagattttccnaaaaancccntattttgagcctatgtgtgtctctgcacgtgagatgggtttcctgaatacagcacactgatgggtcttgactctttatccaacttgccagtctgtgtcttttaattgcagaatttagtccatttatntt

SEQ ID NO: 10831 - DNA, 400 bp, Homo sapiens
  misc_feature 8, 11, 30, 38: n = A,T,C or G
cctgcagngcnccactagtggatccaaagnaattcggntcgagttgaactcttaaacagaaagaaagcttaatataacagcttatagaacttgaactactaaatatgaaaataagtcatttgaaaaaaatacagtatgtaaaatttgttcattcgttgaggtaatggtgctatgtttttacaaaattgttcctacactttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagag

SEQ ID NO: 10832 - DNA, 400 bp, Homo sapiens
  misc_feature 9, 18, 28, 30, 33, 36, 42, 68, 70: n = A,T,C or G
ctttttggnaaacctatnctgagttttntnacnctncagtgnccgactagtggatccaaagaattcgntncgagggaacaacaatatctgctgctagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgt

SEQ ID NO: 10833 - DNA, 384 bp, Homo sapiens
  misc_feature 25, 31, 383, 384: n = A,T,C or G
ctttttgggaacaataagcctgganttttgngcgcctgcaggtccacactagtggatccaaagaattcggttcgagcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtnn

SEQ ID NO: 10834 - DNA, 272 bp, Homo sapiens
  misc_feature 231, 243, 265, 272: n = A,T,C or G
aagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaatactattaaaactgcttttttttttccagcaagtntccaaccaactnggttctgcttcaataaatcttnggaaaan

SEQ ID NO: 10835 - DNA, 400 bp, Homo sapiens
  misc_feature 16, 28, 29, 30, 35, 41, 43, 48, 49, 73, 76, 249, 251, 335,352, 364, 377, 386: n = A,T,C or G
attctgtgggaacaanaaaccccgagtnnntgggngcctgnanagacnncactagtggatccaaagaattcgnttngaggaattaaatatcttttaattccctcttctattatgaaagaagtttatttgtaaaacaaattttctaacaaggtttggccatagaattctcttgtatgattgttgaccttttataatcttctgtaggctatctttcaaacactggcatcagaatattttttataagtttgngnggaaacagcttagttggtcccccccccactcccaagagacttgggtttagttatagctttaagtaaaatttaaaaataaaatgnttttcaggaaacttcgnatctaatggttnggaaattcaaggngcaaaaagntgatttaaaccatt

SEQ ID NO: 10836 - DNA, 240 bp, Homo sapiens
  misc_feature 2, 14, 195, 205, 224, 227, 232: n = A,T,C or G
gngcgcctgcaggnccacactagtggatccaaagaattcggtacgagcttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcanaggatcatgnggaagcagtgaaaaagctncanaactncaccaagg

SEQ ID NO: 10837 - DNA, 389 bp, Homo sapiens
  misc_feature 26, 32, 35, 44: n = A,T,C or G
ctttttgggaaaccataagcctgaanttttgngcncctgcaggncccactagtggatccaaagaattcggttcgagacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 10838 - DNA, 321 bp, Homo sapiens
  misc_feature 223: n = A,T,C or G
gccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggngggtggcccgcatgctggggagggtctaataggaggtttgagctcaaatgcttaaactgctggcaacatataataaatgcatgctattcaatgaattt

SEQ ID NO: 10839 - DNA, 326 bp, Homo sapiens
ccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagatttt

SEQ ID NO: 10840 - DNA, 301 bp, Homo sapiens
  misc_feature 24, 26, 28, 67, 69: n = A,T,C or G
cttttttgaaaaataacctgaatntngngcgcctgcaggtccacactagtggatccaaagaattcgntncgaggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttctt

SEQ ID NO: 10841 - DNA, 339 bp, Homo sapiens
  misc_feature 331, 335: n = A,T,C or G
cactttatcggttacctgctgaagtcactaggacaccaacttgttagtatgcaaattgataaaaagaaaatttaagcatttttttccagccttttctttacaaactgtattttagtgtaactaaaatgttactgaggaaaagttcttcacagaagaattctagctaataaatgcaaactaaatgctataatcagaaaaatcataatttggtaatccttagtgaaatagtggatgtaggcaatgatcattaatggatgctaaaatcattaggtgaaaggttgatggggaggactacgtactagagaggtcagtgtgataccatctgaccagngatnttta

SEQ ID NO: 10842 - DNA, 281 bp, Homo sapiens
  misc_feature 6, 18, 29, 30, 37, 44, 49, 52, 56, 57, 65, 66, 70, 77, 84,94, 95, 98, 101, 107, 148, 163, 188, 199, 240, 243: n = A,T,C or G
attttngggaacataaancggattattgnnggaattnaaaaacnccacnagngganncaaagaannttanggggggnaactttnacaaaaaaanncgnctngattgnggaagatataattgacactggcaaaacaatgcagactttgntttccttgggcaggnagtataatccaaagatggtcaaggncgcaagcttgntggggaaaaggaccccacgaagtgttggatataagccaganttnggggggggggaaattccagacaagtttggtggaggata

SEQ ID NO: 10843 - DNA, 234 bp, Homo sapiens
  misc_feature 2, 19, 44: n = A,T,C or G
tngcgcgcctgcaggtcgncactagtggatccaaagaattcggncgagagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcg

SEQ ID NO: 10844 - DNA, 400 bp, Homo sapiens
  misc_feature 2, 16, 43: n = A,T,C or G
gngcgcctgcaggtcnacactagtggatccaaagaattcggtncgagtccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagca

SEQ ID NO: 10845 - DNA, 284 bp, Homo sapiens
cacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagtttta

SEQ ID NO: 10846 - DNA, 293 bp, Homo sapiens
gaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgat

SEQ ID NO: 10847 - DNA, 327 bp, Homo sapiens
gagacatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctg

SEQ ID NO: 10848 - DNA, 193 bp, Homo sapiens
ccacagagaattattcagtattacattaaaatgttaatgactttttattttaaattgtactaacattaaaagttggcctgaaagtcagatattatgacaaaatttgacattaattgtttttaaagtatagatttcatttgaaattatagaatgctaatgtggttagaggacaccaaagatactgggtcatcag

SEQ ID NO: 10849 - DNA, 312 bp, Homo sapiens
  misc_feature 30, 64, 69, 71, 293, 295: n = A,T,C or G
cttttttgggtaaaaaaccctggttttcgngcgcctgcaggcccgacactagtggatccaaagnaattntncacgagcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgngngttttttttttgcgggc

SEQ ID NO: 10850 - DNA, 336 bp, Homo sapiens
gaagtgggaaagtaatgcaggaagagcagaagcagaggcatactctggctatgaaggaggctactgaaggattattttaaaatgccatgggacatttataagaactgatcatgtactaaatcacaccaaaaatttcaaaatagagcatactaaactcttacaggtcactgtcttttatggtggtgaacgaaaactataataataaattaattaaaggtttaaaaatattcatctatttgaaatagcagttggatcaaagatgatacaaattgaaattagttattatttagaaattaatgacaatgaggacactaaacaagtgccttagggatgtgg

SEQ ID NO: 10851 - DNA, 393 bp, Homo sapiens
  misc_feature 8, 10, 24, 25, 32, 36, 62, 80: n = A,T,C or G
gggaaccnancctgagttttgtgnncctgcgngccncactagtggatccaaagaattcggtncgaggaaaagccttcctntaaaattaaagtaggtttaggaaaacagaccctcaaattctgacattcattttcctaagcaactggatcaatttgctgacttgggcataatctaatctacgcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactattttt

SEQ ID NO: 10852 - DNA, 396 bp, Homo sapiens
  misc_feature 10, 16, 24, 25, 33, 88: n = A,T,C or G
gggaacctancctganttttgtgnncctgcagngccacactagtggatccaaagaattcgtcacgaggaagactgttaccaatgctgnggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagttta

SEQ ID NO: 10853 - DNA, 185 bp, Homo sapiens
  misc_feature 22, 24, 30, 33, 37, 61: n = A,T,C or G
gggaaacctatactgagttttntnaccatncantggncgctagtggatccaaagaattcgntacgagggtgactggagtggccagtgccctgtcctccagataccactgagctcactgcccatgatgcagagctttcaaggataggctttattctgcaagcaatacaaataataaatctattctg

SEQ ID NO: 10854 - DNA, 126 bp, Homo sapiens
  misc_feature 48, 57, 82, 91: n = A,T,C or G
ttgtagagaaattagaacccataaccatacacaggctatcaacatgtnattcaatgngacacctaactcttttctattttgntttttaagnaagacttttattaataaaacaaaatgttttggagc

SEQ ID NO: 10855 - DNA, 384 bp, Homo sapiens
  misc_feature 3, 12, 43, 46, 50, 60, 61, 69, 74, 144, 193, 222, 229, 303: n = A,T,C or G
ctngggggcctntaaaaaccccactagtggatccaaagaattnttnttgngcctaggttnnggggaaangcccnaacgtaccaagaaagtcgggatcgtcggtaaatacgggacccgctatggggcctccctccggaaaatggngaagaaaattgaaatcagccagcacgccaagtacacttgctctttctgnggcaaaaccaagatgaagagacgagctgnggggatntggcactgtggttcctgcatgaagacagtggctggcggtgcctggacgtacaataccacttccgctgtcacggnaaagtccgccatcagaagactgaaggagttgaaagaccagtagacgctcctctactctttgagacatcactggcctataat

SEQ ID NO: 10856 - DNA, 312 bp, Homo sapiens
  misc_feature 62, 197: n = A,T,C or G
gttacaatgttatttaacatctgaatgacactttctgtaagcaaaagcatctcccatgttgnggaggcataattttcctggattgaataggatattagtgttcagaaagaaaagaggataatgatgggtttgaggttgaacaagtgcttttgcaattcctctgaccagttgcagtggaagttcttcctgttactggngaaaatgttggcctcttcctcagccttttatatcactgtatccgaggagaataactcgagggtgcgggacccaaatccatgtgacagtgggttgtgctttatggtcttaggaaga

SEQ ID NO: 10857 - DNA, 315 bp, Homo sapiens
  misc_feature 21, 175, 243, 246, 249, 266: n = A,T,C or G
atgagatcctactactatggnaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgnattaagagaaataagtgcagcatttttgcatctgacattttacctaaaaaaaaaaagaccccaaattnggnggngggggggaaaatcagtngttaccattataaccctacagagggggggagcatgtaacatgagcttat

SEQ ID NO: 10858 - DNA, 338 bp, Homo sapiens
cttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtac

SEQ ID NO: 10859 - DNA, 223 bp, Homo sapiens
tctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaag

SEQ ID NO: 10860 - DNA, 400 bp, Homo sapiens
  misc_feature 17, 25, 32, 38, 40, 41, 68: n = A,T,C or G
cttcttggggaaaaaancccggatntttgggngcgtgnanngccccactagtggatccaaagaattcntttcgagcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttaca

SEQ ID NO: 10861 - DNA, 201 bp, Homo sapiens
  misc_feature 15, 20, 106, 125, 168: n = A,T,C or G
ggacatagtagctgnggggntgcgccagctgctgggggaggagaaataccgccaggacctgactgtgcctccaggctactgcacagacttcctgctgtgcgccagnagctctggtgctgtgcttnccgtgaggacccaggaccccttcctgccatacccaccaaggtnctgcccacagggttcaggctgcctctagcgcca

SEQ ID NO: 10862 - DNA, 350 bp, Homo sapiens
  misc_feature 17, 18: n = A,T,C or G
gatccaaagaattcggnncgagaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagc

SEQ ID NO: 10863 - DNA, 356 bp, Homo sapiens
acacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttg

SEQ ID NO: 10864 - DNA, 329 bp, Homo sapiens
  misc_feature 18, 26, 31: n = A,T,C or G
cagccccccgcccagccnagcatcgnagggntcaggaccaaccgcatagctgcctatgcccccgaagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattc

SEQ ID NO: 10865 - DNA, 362 bp, Homo sapiens
aacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgc

SEQ ID NO: 10866 - DNA, 274 bp, Homo sapiens
cggctgggcgcattggtccatgcctataatcccagcactttgggaggccgagatgtgacgatcacttgaggtcaggagttcgagaccagcctggccaacatggtaaaacctcgtctctactaaaaatacaaaaattagctgggcatggtggtgggtgccttgtaatgccagctaccttgaatgctgaggcaggagaattgcttgagcctgggaggcagaggctccagtgagcccaagattgcgccattgcactccagcctgggcaacaagactg

SEQ ID NO: 10867 - DNA, 325 bp, Homo sapiens
atcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatc

SEQ ID NO: 10868 - DNA, 400 bp, Homo sapiens
  misc_feature 2, 17, 36, 44, 62, 64, 68, 71: n = A,T,C or G
gngcgcctgcaggtccnacactagtggatccaaagnaattcgtncgagaaaacacccgtggngncggnggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactatttta

SEQ ID NO: 10869 - DNA, 252 bp, Homo sapiens
  misc_feature 1, 18, 44, 60, 64, 67: n = A,T,C or G
ngcgcgcctgcaggtccncactagtggatccaaagaattcggtncgaggaaaaatcttgngggnggnatggaatttttctgtgaataaatgtatgactgcatgttattcatttacaagcgtattgaaacttttaagaaactagttgtactgttgcagagattgaaagaaaatagaggcaagcataaaaatagtgaaatgaaagcagctttatttatttatttatttttttaacattttctgccttccctcta

SEQ ID NO: 10870 - DNA, 325 bp, Homo sapiens
ctgatcctaaataagtataacttctgctgaactttctgccgtcataagtgtaacttctgctgaatttttttccatccaggccttggcagtgagatgcgtcagagctgttggagtcagggtgctggcggtcttctgcagcaggggcacctgtcctgagatcaaatgtctgcactggctgaagggcatggtcacaaaccagactaaaccctaagtagactccagttccacattttaaagaacatccttagtttagtttcttgtaaaagcccctatatatgccacaatagttgtcttccaactgtttaatttttcatgatgctatttc

SEQ ID NO: 10871 - DNA, 324 bp, Homo sapiens
gctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatc

SEQ ID NO: 10872 - DNA, 277 bp, Homo sapiens
  misc_feature 2, 6, 7, 9, 27, 44, 45, 69, 80, 137, 152, 192, 198, 200,227, 232, 251: n = A,T,C or G
tncggnncnagaaacattgaagacgtnattgcccagggtattgnnaagcttgctcagtgtacctgctgngggggctgtanccgtctctgctgccccaggctctgcagcccctgctggtggttctgcccctgctgcancaagaggagaacaangatgagaagaagggggagtctgaaaagtcaaatgatgacntggcantnggcctttttgattaaattcctgctccnctgcnaataaagcctttttacacntcgggagtatgagttaagaaaaaaca

SEQ ID NO: 10873 - DNA, 335 bp, Homo sapiens
  misc_feature 227: n = A,T,C or G
ccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgngggcttgtgctcgggatcaaacctttctggcctgttatgattctgaacatttgacttgaaccacaagtgaatctttctcctggtgactcaaataaaagtataattttt

SEQ ID NO: 10874 - DNA, 300 bp, Homo sapiens
cggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacgg

SEQ ID NO: 10875 - DNA, 309 bp, Homo sapiens
  misc_feature 48, 85, 144, 148, 195, 219, 278: n = A,T,C or G
tgctttctgttttttttttaatatgcgataatatgaagctttatatgngtactgggaacttaaatatttcatatcagtttattgncaattcatagtatgctaaatatattagatttcatattctgaaactagtacttatgaaangagngtttatctagtagtaagacctaggatttttacattttccaattaagngcaaatagtatttataagcagagngattatggattgagatgtttttaacttgatggaaggagctagttttcctgagcctgtgngtgcaccaggcactggggctgatgttccagc

SEQ ID NO: 10876 - DNA, 325 bp, Homo sapiens
ctctgctgtggtagatttcggttagcagataactcaggtaaagagttgttgattaaattttacatctacaagtagatgggaaagtttgtcattcagtctttcattgtcagagcaacccagtcccagtggtagcaagctattgaagtggagcatgtgaagatgcgtagttggaatcatagaatatcagggctggaagagatcagagaactttgagcccaacccttctattctgcagaggagaagcatgaattccatacaagttaaatgagttgcctgaggtttgatgtctaatttaataacccgtatatccagaggttccactata

SEQ ID NO: 10877 - DNA, 182 bp, Homo sapiens
agattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacag

SEQ ID NO: 10878 - DNA, 153 bp, Homo sapiens
cttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagcca

SEQ ID NO: 10879 - DNA, 400 bp, Homo sapiens
  misc_feature 382: n = A,T,C or G
cttttgggaaaaaaaaccctggatttcgcgcgcctgcaggtccacactagtggatccaaagaattcggtacgagggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctncttttgctggttggatgt

SEQ ID NO: 10880 - DNA, 138 bp, Homo sapiens
  misc_feature 108, 128: n = A,T,C or G
cacatgaattaatagagtgagaactcactcatgaccatgggcagggcattaagccattcatgagagatccatgtctgtgacacaaacacctcccactggctcaatctncagcattggggtcacatttnaacatgggat

SEQ ID NO: 10881 - DNA, 355 bp, Homo sapiens
ctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagaga

SEQ ID NO: 10882 - DNA, 400 bp, Homo sapiens
  misc_feature 12, 15, 30, 38, 39, 41, 60, 69: n = A,T,C or G
cttttgggaacntancctgagttttgtgcncctgcagnncnacactagtggatccaaagnaattcggtncgaggccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggt

SEQ ID NO: 10883 - DNA, 328 bp, Homo sapiens
ctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattt

SEQ ID NO: 10884 - DNA, 308 bp, Homo sapiens
  misc_feature 278, 289: n = A,T,C or G
agaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtnacaaattatanaatttcccaaaagatgttg

SEQ ID NO: 10885 - DNA, 240 bp, Homo sapiens
  misc_feature 227: n = A,T,C or G
cctaagtgttgaattaatcctctttagatgattataattctcttttcaatagctagaaagaatctataaggaactttcctggctgggtgtggtggctcatgcctgtagtcccagcacttcgggaggccgaggtgggtggatcacggggtcgggagttccagaccagcctgaccaacatggttaaaccatgtctttactaaaaatgcaaaaattggcacctgtaagtnccccagcctactt

SEQ ID NO: 10886 - DNA, 279 bp, Homo sapiens
  misc_feature 55, 100: n = A,T,C or G
ccgttacagtctttttctcaggagctacaaagatctcttcctgttactaaatggncgcaccccagcagcctctctcgcacaccggggccctgcatgtcanatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcaagaca

SEQ ID NO: 10887 - DNA, 400 bp, Homo sapiens
  misc_feature 14, 17, 29, 33, 41, 42, 369: n = A,T,C or G
ctttttgggtaacntanccctgagttttntganacctgcanngaccacactagtggatccaaagaattcggttcgagcgaccctgccgatgtggccctccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatngatgtggcccccttggacgttggtgccccag

SEQ ID NO: 10888 - DNA, 400 bp, Homo sapiens
  misc_feature 33, 40, 41, 44, 45, 46, 63, 70, 73, 215, 249, 291, 357, 377,382, 399: n = A,T,C or G
accttttgggaaaaaatccctgagttttgtganaatgaanngcnnnactagtggatccaaagnaattcgnttngagccaggttctgtgccactcagagggaccctggcaggggccagaaccacttaagggtggtgctggagggccttgtgccccagtcccatcccaggacgccctgagggatggacgcagccatgcaccccccatctggggcctntccctgctccctctcccacctggcagctgggagntctggcttctaggcctgccctgtcaccaggcctttgagtggncaggcccttccacctccccatctgtaaaacgaggcagctgcccgggacagccttggggtccttagnggccctgcaggtcctctggnagctntgctgaccccacccttnt

SEQ ID NO: 10889 - DNA, 264 bp, Homo sapiens
gagatatgggacctttcagaaagagagcttaaaatagctgttttgaggaaactcaaattcaaggtaacacagaggaggaactcagaatattatcagatacatttaacaaaggaattgaagtaagttaagagaatcaggcagaaattctcgagctgctgaatgcaattgacgtactgaagaatgcgtcacagtctgttagtagcagaactgatcaagcagaagaaagaattagtgagcttgaagacagactatttgaaaatacac

SEQ ID NO: 10890 - DNA, 395 bp, Homo sapiens
  misc_feature 9, 11, 23, 25, 30, 32, 35, 38, 65, 225, 355: n = A,T,C or G
gggaaaccnanacctgagttttntnacaantnaantgnccgactagtggatccaaagaattcggntcgagcccagctcggcacttggcagctctgtccctaaggcgacgcacctgggctgctctgctggcagcccctggttcctgcttcaccgtcgcgtggaggcctggggcacctgctttctgctacacctctcctaggagcgcgaaacagatggagtgacacntcgtcgagggcctctgcgggactgtctgtttgcagagggtgccaaaggtgtccactgcgtaaggaagggcaaagtcctttggggcaaagaaccctgagaggaacggggagatggatttttgaaagcaaangaaccctctcctaaaagtgactgtcactgacctgaaaaca

SEQ ID NO: 10891 - DNA, 315 bp, Homo sapiens
  misc_feature 155, 194, 229, 274, 285, 288: n = A,T,C or G
ggcgtttgtagtaagtgatttcactggccctggggggacagatggtagacagtgtttgatcccagtctttgcagggctctagcccctcgcagcttctgcaccttctctgcatggacaggaaagtggccttgtcacctcagagccaccaaaaatgnggctgttttccatttttaatttcttcacggggatatttntttatatttttaaaattaagcagggggctggccgnggggggttcgcttcctgtaatcctaaaactttgggaggccaaggngggagggatcnggntgagcctaggaggtctaggcctgcggg

SEQ ID NO: 10892 - DNA, 174 bp, Homo sapiens
ctcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcc

SEQ ID NO: 10893 - DNA, 248 bp, Homo sapiens
gacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcac

SEQ ID NO: 10894 - DNA, 366 bp, Homo sapiens
aagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggccccttccctgccctccattcagggagaaacctctcctt

SEQ ID NO: 10895 - DNA, 392 bp, Homo sapiens
  misc_feature 66, 148: n = A,T,C or G
ctttttggaacataagccggagtttgtgcgcctgcaggtcccactagtggatccaaagaattcggntcgagcaggcgcagcccagcctcgaaatgcagaacgacgccggcgagttcgtggacctgtacgtgccgcggaaatgctccgntagcaatcgcatcatcggtgccaaggaccacgcatccatccagatgaacgtggcccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatattttgtcataaataaataatg

SEQ ID NO: 10896 - DNA, 336 bp, Homo sapiens
caaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttga

SEQ ID NO: 10897 - DNA, 319 bp, Homo sapiens
ctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagcctcttgcccatgattcagagctttcaaggataggctttattctgcaagcaatacaaataataaatctattctgctga

SEQ ID NO: 10898 - DNA, 315 bp, Homo sapiens
  misc_feature 22, 26, 283, 309: n = A,T,C or G
cttttgggtaaaaaaaccggantttngcgcgcctgcaggtccacactagtggatccaaaaaattcggtacgagagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggaggggctgggacaactacgagtttgacatcaatgaagnggaggaaggccctgtcttcgccatgngcatgg

SEQ ID NO: 10899 - DNA, 400 bp, Homo sapiens
  misc_feature 11, 20, 31, 33, 34, 35, 40, 43, 44, 67, 74: n = A,T,C or G
cttttttgggntaacctatncctgagttttntnnnacctncannggccagactagtggatccaaagnaattcgntacgagcagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcc

SEQ ID NO: 10900 - DNA, 316 bp, Homo sapiens
gctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttaca

SEQ ID NO: 10901 - DNA, 202 bp, Homo sapiens
ggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgttcttacattaacaaaaacaattaaaaacaccaaaaac

SEQ ID NO: 10902 - DNA, 325 bp, Homo sapiens
gtgaatttttttagataattttcagtttcaaatttacacttggttcttttttagagattatgtttctctgctgtgatttactaccttcttagtgagtacaagcatattttccctcagttataatagctgccttaaaatttaattctcatcatctggattatcctagggatggggccattcattgccttttctcttctgtatgggtcacagttccctgtttcattgtatatctactaattgaggattttatcgtacatgttattgatatgaagagtctggattatgttatgtttctataaagaatgttgacttttttgttttcgca

SEQ ID NO: 10903 - DNA, 400 bp, Homo sapiens
  misc_feature 7, 9, 37, 60, 63, 211: n = A,T,C or G
aatgaangnccacactagtggatccaaagaatttttncgagcgcagattgaccccaactnggnggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatcttnggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtg

SEQ ID NO: 10904 - DNA, 378 bp, Homo sapiens
  misc_feature 7, 18, 25, 28, 34, 58, 84, 167, 181, 348: n = A,T,C or G
aacctanacccgagtttntgacatnaantggccnctagtggatccaaagaattcgttngagtgggctttgcgagggaacatcgnatccgaagtctcccagcacttaacggcccccatgccggtgtcccctctttggaatccttattcagctctgaattacaatccgncccaatgttgacgngggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgacctttggggaaaaaggangggaaggaaaaccttgaaaccccggaagcc

SEQ ID NO: 10905 - DNA, 398 bp, Homo sapiens
  misc_feature 3, 7, 33, 34, 53: n = A,T,C or G
aantgcnacactagtggatccaaagaattcttnncgagcgctggaagcctgcngatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagcttgctgagcaaagtgggatcgaccagccagcccaccttggagaccttccaggacctgctgcacagacaccctgatgccttctacctggcccgtaccgggaaggcccctgcagg

SEQ ID NO: 10906 - DNA, 360 bp, Homo sapiens
  misc_feature 2, 172: n = A,T,C or G
gngcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgncttgtttcagtgagagacgccctatttctatgtcatttttaatgtatctatttgtacaattttaaagttcttattttagtatacatataaatatcagtattctgacatgtaagaaaatgttacggcatcacacttatattttatgaacattgtactgttgctttaatatgagcttcaatataagaagc

SEQ ID NO: 10907 - DNA, 326 bp, Homo sapiens
ggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataaccgtgttttgttttgttttttaaattagaaaaataaggaattgcagtgtgatt

SEQ ID NO: 10908 - DNA, 394 bp, Homo sapiens
  misc_feature 13, 25, 31, 32, 34, 37, 40, 43, 67, 70, 89: n = A,T,C or G
ggggaaacctatncctgagtttttntgaccnntnaantgnccncgactagtggatccaaagaattcnttncgagggctgagtggctacnaagactttatcaaattattttaaatgttggcatttaagtattcatgtgtatacagttacatggaaccttcaggtcagtggggcacaaatgtggtatacacacgatgagcctggcagggaagcaaatgagaccaggcttggagctacagggatttaaaaaaattggatgtctttctgagggtctgagaagaatagggcagaagaggaaagggtcactttaggggtctggcttaacccactgcctagatctccaactgaagagctcctttcccatcctcaggggaagagtgcctgttttcaaacggc

SEQ ID NO: 10909 - DNA, 400 bp, Homo sapiens
  misc_feature 14, 16, 35, 41, 44, 49: n = A,T,C or G
gtgcgcctgcaggncnacactagtggatccaaagnaattcnttncgagnaaagcaaggaatttaatgccgaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaatttt

SEQ ID NO: 10910 - DNA, 326 bp, Homo sapiens
ctttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttg

SEQ ID NO: 10911 - DNA, 280 bp, Homo sapiens
ttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttggggctgtgtttttggtatgtgtttactgtgttttcccaaatccaaaatgtgttttggttacaggagttcagtatttggaaactaatttgttctactttttcattata

SEQ ID NO: 10912 - DNA, 207 bp, Homo sapiens
cactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttatt

SEQ ID NO: 10913 - DNA, 208 bp, Homo sapiens
caagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttac

SEQ ID NO: 10914 - DNA, 365 bp, Homo sapiens
gaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactgg

SEQ ID NO: 10915 - DNA, 377 bp, Homo sapiens
  misc_feature 7, 8: n = A,T,C or G
cctgagnncccactagtggatccaaagaattcggttcgaggagattcaaagcctccacgactctgtttcccccgtcccttctgaatttaatttgcactaagtcatttgcactggttggagttgtggagacggccttgagtctcggtgcgagtgtgcgtgagtgtgagccaccttggcaagtgcctgcgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagcccctggactcat

SEQ ID NO: 10916 - DNA, 398 bp, Homo sapiens
  misc_feature 1, 17, 43: n = A,T,C or G
ngcgcgcctgcaggtcnacactagtggatccaaagattcggtncgagtgatggctgggcctaaatgccccaaccacctacttgggacaggaaatgacaggaccctctcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagctttt

SEQ ID NO: 10917 - DNA, 400 bp, Homo sapiens
  misc_feature 2, 24, 27, 41, 70, 88, 89, 90, 91, 92, 96: n = A,T,C or G
anttttgggaacaaaaacctgganttngcgcgcctgcaggnccacactagtggatccaaagaattcggtncgagattcttcagaggcnnnnnaggntctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaag

SEQ ID NO: 10918 - DNA, 256 bp, Homo sapiens
  misc_feature 23, 24, 37, 41, 68, 86, 188, 201, 209, 219, 228: n = A,T,C or G
atttttgggaacaaaaacctggnnttcgcgcgcctgnaggnccgacactagtggatccaaagaatttngcacgagaaaagggccgntctgccttcaacgaagtggtaacccgagatacaccatcaacattccaagcgctcctgggagtgggcttcaagaagcgtgcacctcggcactcaagagattcngaatttgcctganaggagatnggacttccanatgtgcgcntggcaccaggctcaacaagctgctgggc

SEQ ID NO: 10919 - DNA, 398 bp, Homo sapiens
  misc_feature 15, 24, 70: n = A,T,C or G
atttttgggaacaanaacctggantttgcgcgcctgcaggtccacactagtggatccaaagaattcggtncgagtgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttcccc

SEQ ID NO: 10920 - DNA, 348 bp, Homo sapiens
  misc_feature 3, 6, 50, 52, 271, 321, 337: n = A,T,C or G
ccnggnttttgcgcgcctgcaggtcccactagtggatccaaagaattcgntncgagcgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctggccctttaacagcttttgncccggagctagacttcgggtcctttcagttgggaaaatggttttctatanaatcaataatattttntttctttaaat

SEQ ID NO: 10921 - DNA, 210 bp, Homo sapiens
  misc_feature 2, 9, 45, 69: n = A,T,C or G
tnttttggnacaaaaaccccggttttttgcgcgcctgcaggtccncactagtggatccaaagaattcgnttcgagtggaactgaaaaccaaggcacaagaactacgtgatgaatgcagaatcctcagtagccgatgcgatcaactggaagaaagggtatcagtgatggaagatgaaatgaatgaaatgaagtgagaagagaagtttagag

SEQ ID NO: 10922 - DNA, 400 bp, Homo sapiens
  misc_feature 8, 25, 33, 39, 71: n = A,T,C or G
ctcctttngggacaaaaacccggtnttttgtgngcctgnagaaaccccactagtggatccaaagaattcgntttgagaaggactaacccctatacctccctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 10923 - DNA, 281 bp, Homo sapiens
  misc_feature 2, 37, 39, 41, 62, 68: n = A,T,C or G
antcttggggaaaaaacccggttttttgggcgcctgnangnccccactagtggatccaaagnaattcntttcgagcccagccgaaaacaaccaagaattttttaacaataaaatgaccagcaagtaaacttgaaacaaaaatggacaaatatctaaaatatttttaaatgtatgtattttaattggcaaataatacttgtatatattgtttacaacttgttttaaagtatgaatacattgtggaatggctaaatcaagttaattaacatgcattaactcac

SEQ ID NO: 10924 - DNA, 400 bp, Homo sapiens
  misc_feature 4, 8, 35, 37, 64, 84, 85, 247, 248, 273: n = A,T,C or G
accncttngggaaaaacccgtttttgggagcctgnanaaaccactagtggatccaaagaattcnttttgagggaaaaacagagnncagagccggggaagaagcacaagaaaaagagggttgtccccaaaaagcctcccccatcaccccaacctacagggaaaattgagatcaaaattgtccgcccatgggctgaagggactgaagagggtgcaccgttggctgactgatgaggacacgagaaacctnnaggagatcttcttcaatatcttggngccgggagctgaagaggcccagaaggaacgccagcggcagaaagagctggagagcaattaccgccgggtgtggggctctccaggtggggagggcacaggggacctggacgaatttgacttctgagac

SEQ ID NO: 10925 - DNA, 221 bp, Homo sapiens
  misc_feature 25, 27, 68: n = A,T,C or G
acttttggaacaaaaaccggatttngngcgcctgcaggtcccactagtggatccaaagaattcggttncgagagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattgg

SEQ ID NO: 10926 - DNA, 398 bp, Homo sapiens
  misc_feature 3, 5, 156, 157, 158, 217, 352: n = A,T,C or G
cancnctttgctgactttcagctagaactcattcagctcccagaggccacccacattcttttccatgctttttatgtggcccctctagcaactaggttaagtttttctcaattcaaatccctctgccttttcccttagccctacccgtcttacatnnncttctgctgtatctctatcatgttctcttccaccgatagccaggagaaagatctgattnttgttttgttttgttttgttttgagatggagtctctccctgtcacccaggctggagcgcagtggcataatctcggctcactgcaaccctctgcctaccgggttcaaacaattctcctgcctcagcctcccgagtngctggggatcacaggtggccaccacccacacctagctaaatttgtt

SEQ ID NO: 10927 - DNA, 279 bp, Homo sapiens
  misc_feature 2, 36, 40, 66: n = A,T,C or G
antcttgggacaaaaacccggtttttgggcgcctgnaganccccactagtggatccaaagaattcntttcgaggttaagctggctgtcctgacatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaa

SEQ ID NO: 10928 - DNA, 308 bp, Homo sapiens
  misc_feature 22: n = A,T,C or G
gggaaaaaaacccggattttgngcgcctgcaggtcccactagtggatccaaagaattcggttcgaggcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtg

SEQ ID NO: 10929 - DNA, 358 bp, Homo sapiens
  misc_feature 9, 19, 41, 66, 68: n = A,T,C or G
ggggacaanaagcccgganttttgtgcgccttgaaggtgcnccactagtggatccaaagaattcgntncgagcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactg

SEQ ID NO: 10930 - DNA, 341 bp, Homo sapiens
  misc_feature 15, 172, 175: n = A,T,C or G
tgagggtcacattgngctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgntgncagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctg

SEQ ID NO: 10931 - DNA, 305 bp, Homo sapiens
gccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactg

SEQ ID NO: 10932 - DNA, 349 bp, Homo sapiens
caatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaat

SEQ ID NO: 10933 - DNA, 137 bp, Homo sapiens
  misc_feature 7, 10, 12, 33, 39, 40: n = A,T,C or G
cgcctgnagnanccccactagtggatccaaagnaattcnnttcgaggtcctacacaatggggctacctctgtgtcaaacacctctgtattttttaaaacatcaattgatattaaaaatgaaaagattattggaaagt

SEQ ID NO: 10934 - DNA, 400 bp, Homo sapiens
  misc_feature 3, 6, 30, 32, 38, 40, 43, 68, 91, 130, 248, 251, 359, 386,392: n = A,T,C or G
acnctntgggacaaaaacccggttttttgngngcctgnanaancccactagtggatccaaagaattcnttttgagcttcaggggagattgnctaccgtgggcaggtgtttgagaagtcccccctgcgggngaagaacttcgggatctggctgcgctatgactcccggagcggcacccacaacatgtaccgggaataccgggacctgaccaccgcaggcgctgtcacccagtgctaccgagacatgggngcncgggcaccgcgccccgagcccactccattcagatcatgaaggtggaggagatcgcggccagcaagtgccgccggccgggttgtcaagcagtttcacgactccaagatnaagttcccgctgcccaccgggtcctgngccggnggcaaagc

SEQ ID NO: 10935 - DNA, 226 bp, Homo sapiens
  misc_feature 29, 39, 43, 46, 70, 72, 92, 97: n = A,T,C or G
atctttgggaaaaaaaaccccggtttttngggcgcctgnaggnccncactagtggatccaaagaattcgntncgagaaggttctggaacagnttttngtcctgtacccagtgttaccctcgttattttgtaaccttccaattcctgatcacccaagggtttttttgtgtcggactatgtaattgtaactatacctctggttcccattaaaagtgaccattttagtt

SEQ ID NO: 10936 - DNA, 399 bp, Homo sapiens
  misc_feature 5, 35, 62: n = A,T,C or G
cctgnagggccccactagtggatccaaagaattcntttcgaggcttatgaatctatttaaanttgaatattttatgttgacttctttcatactagctgaaacttgctctaaagagcttcctttggaatctttagatttctttttataaggttcaattcagtacatccataaatcgacagaatgaagaaaacataacaaaaagccacctattccttcctcttgctcccttattagctaaagtaaaatttacatctgtaagacttactgagttgctgccaaaatggaactgaattcttaaaagcaggaacgtgcctatgtgaaacattagaaaaccaaaataaatgggaaaattcagacttgaagagctgaatcatgtgacaacaaagtactgatcttaat

SEQ ID NO: 10937 - DNA, 395 bp, Homo sapiens
  misc_feature 14, 17, 24, 36, 39, 62, 63: n = A,T,C or G
gggacaaaaacccnggntttttgngcgcctgcaggnccncactagtggatccaaagaattcnnttcgaggcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtga

SEQ ID NO: 10938 - DNA, 171 bp, Homo sapiens
  misc_feature 8, 11, 37, 42, 59, 65: n = A,T,C or G
gcgcctgnaanaccccactagtggatccaaagaattnttttngagagagatgcccctgntggccncaaagtgggtctcattgctgcccgccggactggacgtctccggggaaccaagactgtgcaggagaaagagaactagtgctgagggcctcaataaagtttgtgttta

SEQ ID NO: 10939 - DNA, 322 bp, Homo sapiens
ggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaatttt

SEQ ID NO: 10940 - DNA, 400 bp, Homo sapiens
  misc_feature 3, 19: n = A,T,C or G
gcnctagtggatccaaagnaattcggcacgaggtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctt

SEQ ID NO: 10941 - DNA, 326 bp, Homo sapiens
  misc_feature 4, 8, 29: n = A,T,C or G
ctgnagtncgacactagtggatccaaagnaattcggcacgaggacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaac

SEQ ID NO: 10942 - DNA, 397 bp, Homo sapiens
  misc_feature 2, 14: n = A,T,C or G
gngcgcctgcaggncgacactagtggatccaaagaattcggcacgagggcacccgccaccgtacctggctagtttttgtatttttagtagagacggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggttggagggcgcgtcacccacgggtgggccttgtgtcgccttgtatcggcccaggtaggttgttggcctcttacttgggctgacctgac

SEQ ID NO: 10943 - DNA, 336 bp, Homo sapiens
  misc_feature 7, 8, 29, 210: n = A,T,C or G
ctgcagnncgacactagtggatccaaagnaattcggcacgagcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgngtgtttagaagcctaattgtcacatcaagcatcattgtccccatgcaacaaccaccaccttatacatcacttcctgttttaagcagctctaaaacatagactgaagatttatttttaataatgttg

SEQ ID NO: 10944 - DNA, 244 bp, Homo sapiens
  misc_feature 9, 17, 41, 129, 134, 141, 185, 200, 233: n = A,T,C or G
ccttgcggntcggacantagtggatccaaagaaattcggcncgagcagaaaatgacttgaacaagggattgcctgcctcactgcattgcggaagatacaatttttgtaaagaacacaaatagcagttgngaatnttaaggngtgattatctttccctgtccatgtgcttattgaaagaagatagngaacaaatgattatnttgaggatttttttaatttataagatctaatgngaaatccacac

SEQ ID NO: 10945 - DNA, 400 bp, Homo sapiens
  misc_feature 8, 24, 31, 38, 129, 239, 242, 243, 355: n = A,T,C or G
ctgatganttggagttctgtgtgngccactnacgctgngacactagtggatccaaaaaattcggcacgagccccgcaaggaaggtaccggctctactgccacctcttccagctccaccgccggcgcagnagggaaaggcaaaggcaaaggcggctcggggagattcagccgtgaagcaagtgcagatagatggccttgtggtattaaagataatcaaacattatcaagaagaaggacanggnnctgaagttgttcaaggagtgcttttgggtctggttgtagaagatcggcttgaaattaccaactgctttcctttccctcagcacacagaggatgatgctgactttgatgaagnccaatatcagatggaaatgatgcggagccttcgccatgtaaacat

SEQ ID NO: 10946 - DNA, 399 bp, Homo sapiens
  misc_feature 23, 51, 166, 223: n = A,T,C or G
gtgggcgctagtggatccaaagnattcggcacgagctcgtgccgattcggnacgaggaattcccctgacaacatagaattaattatttctcagtcaaaaggtatgttttaacccactcttgggagcttaagaggctcccctgttttcaggagtacatgattactgngaggtactagaccttgaagtccacgtaggtcttctatattgctttcctcatggggtnggcttgcaaagaagcagtgtagtggcacaaattaataagctttgcaatttcaggggcagaatgggcgttaccatgcttgtcttgctgaaagggagtaacctactctaattttgttagacacggctggatacaaccagtcttttttttttctggcaactctccttgcatgggaaggg

SEQ ID NO: 10947 - DNA, 400 bp, Homo sapiens
  misc_feature 5, 21, 395: n = A,T,C or G
gacgnctagtggatccaaagnaattcggcacgagtggagcttcaaaattctaaatattacatgatttaatataaatttaatattagagcttttaaaacatcaaaattgtgttttggaatcagaatagataatgagattctaaatttcaaaacaaaatcatcatatgaaaattatttataatattaatagtgtcaccattatatttagtagaaaatcaaaattattagataaatgaccttgagaaacctactaatattttggaaaatagtaaagtcagtggtgaggagccaagatggctgatgtgtacttcccactgagaagattgaaaacggtgagtgaatcctgctccatcatcccaggtatacaggttctctcacttggactgacaaggcagngggtg

SEQ ID NO: 10948 - DNA, 400 bp, Homo sapiens
  misc_feature 204, 316, 342, 395: n = A,T,C or G
aataagctggaagctcgcgcgcctgcaggtcgacacctagtggatccaaagaattcggcacgagggagatgggggttttatatataagtccctgactggggctgctgccttttttttcagagatgccctgcccagagaggaggaaactagagagggagtcggtcttgctgagctgtggtgggctccgcccagttcgaacttccnggcagctttgtttacactatgagggtaaaaccacctactcaagcctcagcaatgtcaagactccacttcccctaccaagctccagtgtctcaggtcaacctcagactgctgngctagcagcaagaatttcaagccagnggatcttgagcttgctggggctccatgcagggggggacctgctgagctaggcncctga

SEQ ID NO: 10949 - DNA, 400 bp, Homo sapiens
  misc_feature 2, 5: n = A,T,C or G
cntgnaggtgcgacacctagtggatccaaagaattcggcacgagcacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagat

SEQ ID NO: 10950 - DNA, 398 bp, Homo sapiens
  misc_feature 15, 18, 41: n = A,T,C or G
gtgtgcgccttgacngcngggacgactagtggatccaaagnaattcggcacgaggaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttacta

SEQ ID NO: 10951 - DNA, 396 bp, Homo sapiens
  misc_feature 16: n = A,T,C or G
ataagctggagctcgngcgcctgaggttcgacactagtggatccaaagaattcggcacgagattaaaaacccaaaggaactgagggaagtgtggcagcaccgaagatcagatgcagtggttttcagatgcctgactgttcttaatctaatcaggaaaccctccagcctgatgtaattctttccaacaaaagctcctaaggctttcattctgtttctttgtcttgcactagatatattcttctttggtgaatttgatttaactcaaatgatttaaattacaagttaaggaaaacgtgatttattatcatttgctggcctgcccaaagctcagttagactaggttcctgttacttagtgttcagagatccatgtcagtttttctgctggcacaccctc

SEQ ID NO: 10952 - DNA, 400 bp, Homo sapiens
aacaataagctggagctcgcgcgccctgcggtcgacactagtggatccaaagaattcggcacgagaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagagg

SEQ ID NO: 10953 - DNA, 400 bp, Homo sapiens
  misc_feature 9, 15, 27, 49: n = A,T,C or G
gactggagnctgcgngcgccctgcagngcgacactagtggatccaaagnaattcggcacgagcttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaag

SEQ ID NO: 10954 - DNA, 315 bp, Homo sapiens
  misc_feature 9, 25, 30, 36, 39, 61: n = A,T,C or G
aaacaatangactcggaagctgcgngcgcncctgcnggngcgacactagtggatccaaagnaattcggcacgagccaaactctatcattctgtccctggtccctcccaaatctcatgtcttcacatttcaaaaccaattgtgccttctcaacagtcccccagattcttaactcatttcagcattaactcaaaagttcggccaggtgcggtggctcacacctgtaatcccagcactttggcaggccaaggcgggtggatcatgaggtcaggagatagagaccatcctggccaacacggtgaaaccccgtctctact

SEQ ID NO: 10955 - DNA, 400 bp, Homo sapiens
  misc_feature 2, 22: n = A,T,C or G
gngacactagtggatccaaagnaattcggcacgagtttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaatcacaccattgctcacagaattggcatctcatttttgggacctcccatctttctgttttgaaaagtgtacagtagtgcagtgttcctg

SEQ ID NO: 10956 - DNA, 174 bp, Homo sapiens
  misc_feature 3, 32, 39, 47, 62, 93, 97, 107, 130, 132: n = A,T,C or G
ctnatggatcccaagaattcggcacgagctgnactgggnagactgcnaaataaaatctcggnggtctatttatttattggcttcctgtaagancttngggtcaaggnacgaggcatggaaactaactggngngagtcaaatgccccctgagtgactgcccccagcccaggccag

SEQ ID NO: 10957 - DNA, 400 bp, Homo sapiens
  misc_feature 11, 13, 27, 29, 34, 38, 66, 71, 82, 86, 146, 165, 183, 229,240, 250, 346, 383: n = A,T,C or G
atgactggagntncgtgcccttgcgcngngacantagnggatccaaagaaattcggcacgagtaancaggngcccacaaganggtntgccagattgtcagcgaaacctgctccaccaaaacctgaacccaaaccaagaaaaacatntgctaagaaagaacctggngcaaagattagcagaggngctaaagggaagaaggaggaaaagcaggaagctggaaaggaaggtncctgcaccatntgaaaatggngaaactaaagctgaagaggcacagaaaactgaatctgtagataacgagggagaatgaattgtcatgaaaaattggggttgattttatgtatctctngggacaacttttaaaagctatttttaccaagtatttngtaaatgctaatttttt

SEQ ID NO: 10958 - DNA, 197 bp, Homo sapiens
  misc_feature 3, 7, 58, 59, 124, 176: n = A,T,C or G
tgnaggntcgacactagtggatccaaagaattcggcacgagctcgtgccgaattcggnncgagaaaggcttcagagtagatatctctgccaacatgaggacagaaggactggtgcgaccccccncccccgccccctgggcttaccatctgcatggggctggggtcctcctgtgctntttgtacaaataaaccctgag

SEQ ID NO: 10959 - DNA, 243 bp, Homo sapiens
  misc_feature 21, 28, 180: n = A,T,C or G
aaaagctggagctcgcgcccntgaggtncgacactagtggatccaaagaattcggcacgaggctatcaacaagaaaaaaccatgaattatgtgggaaattttagacaaggacattttgtgcagaatgatagtgaatgagaatttaggcaacttaaaatttttgtcctggctgggcatggnggttcatgtctgtaatcctagtgctttgggattgaggctgggagtttaagaccagcctgggga

SEQ ID NO: 10960 - DNA, 399 bp, Homo sapiens
  misc_feature 9, 46, 48, 75, 115, 138, 178, 187, 196, 217, 239, 278, 294,296, 316, 345, 367, 369, 386: n = A,T,C or G
gacactagnggatccaaagaattcggcacgagaaaattcatggctngngatgtataaaataaaatattctttgcngtaaaatattccctttgttaatgttatagaaggggggatncaaaaaggaactaacaatttgtntggcagggtcagatatttttattttagtatttcctgtttnggtttattngcatcttanaagagcataatgacattgttngatgaagcctaattatgctggnctgttttgacctggtttaacccttctgataggtagttgnggatgctggggatgananctgaataatctttgcctggngggacactacactctagaatttccacttnggagaatactcagttccaactngngattcctgatagaacanactttacttttct

SEQ ID NO: 10961 - DNA, 400 bp, Homo sapiens
  misc_feature 3, 21: n = A,T,C or G
cgnaagactggagctcgcgcncctgcaggtcgacactagtggatccaaagaattcggcacgaggctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataagg

SEQ ID NO: 10962 - DNA, 400 bp, Homo sapiens
  misc_feature 10, 18: n = A,T,C or G
agctcgtgcncctgcggncgacactagtggatccaaagaattcggacgagaaaccttctccactaaacgtcgttagggcctcagttctagacgagtatacctgattcacctgcactgcttcccccgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctccctcggcaccgcgttcggaggacgcacccctcactcccctgctgccttcactcctttct

SEQ ID NO: 10963 - DNA, 161 bp, Homo sapiens
  misc_feature 4, 11, 61, 148: n = A,T,C or G
gtgncccttgnaggtgcggacactagtggatccaaagaattcggcacgagctcgtgccganttcggcacgagtcgccatgaaggtcgagctgtgcagttttagcgggtacaagatctaccccggacacgggaggcgcttcccccgggnccgacgggaaggt

SEQ ID NO: 10964 - DNA, 300 bp, Homo sapiens
  misc_feature 18, 21, 91: n = A,T,C or G
cgtaagactggagctcgngcncctgcggtcgacactagtggatccaaagaattcggcacgagctgatatgaagaatagagtaccaatgtcnttaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactga

SEQ ID NO: 10965 - DNA, 399 bp, Homo sapiens
  misc_feature 9, 36, 37: n = A,T,C or G
aaaacttangactggaagtctcgtgcgccctgcagnncgacactagtggatccaaagaattcggcacgagctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcat

SEQ ID NO: 10966 - DNA, 329 bp, Homo sapiens
  misc_feature 11, 14, 77, 88, 96, 247, 258, 281, 286, 324: n = A,T,C or G
tcgacactagnggntccaaagaattcggcacgaggtcatctttagaagtattgaggaagaaaaggaacctgcagaantatcagcaatnttgacagnggctcttttaaggcacctgaatcaatggaccgggagttctttgagcccaggtcgtaagatagacagagaagtctattttagagacctctgaatcttcttgttctgattccaagctcaccaaactgccactgattcctaaatagtttgattntgggagatgancgtgggaaggggaggttgcccgngaggngagatggttccactgcactccagcctggatgacagagngaggc

SEQ ID NO: 10967 - DNA, 185 bp, Homo sapiens
  misc_feature 9, 64, 82, 98: n = A,T,C or G
gacactagnggatccaaagaattcggcacgagcatatatgtccatatttacattttgatagccnttgatgtatgcatctctnggctgtactataagancacattaattcaatggaaatacactttgctaatattttaatggtatagatctgctaatgaattctcttaaaaacatactgtattctg

SEQ ID NO: 10968 - DNA, 236 bp, Homo sapiens
  misc_feature 4, 22, 29, 30: n = A,T,C or G
aaantaagctggagctcgcgcncctgagnncgacactagtggatccaaagaattcggcacgaggcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcaagtaaactttg

SEQ ID NO: 10969 - DNA, 167 bp, Homo sapiens
  misc_feature 3, 66, 143, 165: n = A,T,C or G
aancgaagctggagctcgcgcgcctgcaggtcgacactagtggatccaaagaattcggcacgaggngctagaatactttttaaaaggtattttgaataccattaaaactgcttttttttttccagcaagtatccaaccaactnggttctgcttcaataaatcttngg

SEQ ID NO: 10970 - DNA, 400 bp, Homo sapiens
  misc_feature 2, 11, 27, 256: n = A,T,C or G
angctgggacnctagtggatccaaagnaattcggcacgagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgngcacaaaagaaaagcacaaaagttgaatgcacatggggcatgtgcttttctgtgcaccaaatatctggatgaggttcttttttcaggcctacagtcaaatctgtgtccagaattttttgacttttttgctttgtataatcatag

SEQ ID NO: 10971 - DNA, 398 bp, Homo sapiens
  misc_feature 4, 6, 32: n = A,T,C or G
accntncgtgggacgactagtggatccaaagnaattcggcacgagcctaaatgtccaccaggaaatggacagataaataaaaatgatttgctcttaccaaaaatgttaaaataactttaaataatgataaggtgggtctacatgtatggacctggaaaaatgccattacattttcagaggacaaaaacactcataaaataggatgtaatatgtgatctcatttttataattccacgtctttgcatttttgtctgtcttttgtgtgtagaaaaagaaaataatgtgaaactaataccaacttcaagaattaaggggatgaaattacacagtggagatttttaacctttatttttatatattctgaaatatttggaatggtgaacagtcattgctttaat

SEQ ID NO: 10972 - DNA, 328 bp, Homo sapiens
  misc_feature 4, 24, 29, 38, 70, 161, 251, 287, 322: n = A,T,C or G
aagnctggagctcgtgccccttgnaggtngacactagnggatccaaagaaattcggcacgagggggagtnggggaatcggttgttctttcctcacatttggatgattgtcataaggtttttagcatgttcctccttttcttcaccctccccttttttcttntattaatcaagagaaacttcaaagttaatgggatggtcggatctcacaggctgagaactcgttcacctccaagcatttcatgaaaaagcngcttcttattaatcatacaaactctcaccatgatgngaagagtttcacaaatccttcaaaataaaaagtantgcctt

SEQ ID NO: 10973 - DNA, 207 bp, Homo sapiens
  misc_feature 5, 7, 33: n = A,T,C or G
ccatnangctgggacgactagtggatccaaagnaattcggcacgagcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatc

SEQ ID NO: 10974 - DNA, 144 bp, Homo sapiens
  misc_feature 8, 11, 45: n = A,T,C or G
gttgagtngtnttacaattaactgggacgctagtggttccaaagnaattcggcacgagcctggctgacacggtgaaacccctgcagtgagccgagatggcgccactgcacctccagcctgggcgacagagcgagactccatctc

SEQ ID NO: 10975 - DNA, 353 bp, Homo sapiens
  misc_feature 2, 3, 193, 340, 352: n = A,T,C or G
gnncgacactagtggatccaaagaattcggcacgagcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagcntgtggtgacagctgacctgaggctcaacgagccccgctacgccacgcttgcacaacatcatgaaagccaagaaagaagaagatcgaggtgatcaaagcctggggacctgggtgtggacctgacctccaagctctctgtgatcagtgngggaggaccccnc

SEQ ID NO: 10976 - DNA, 397 bp, Homo sapiens
  misc_feature 4, 6, 32, 47: n = A,T,C or G
accntnaagtgggacactagtggatccaaagnaattcggcacgaggnggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcgggttccagcagcagcagtagcctatggcagtggcagaagattttaattaggaaac

SEQ ID NO: 10977 - DNA, 260 bp, Homo sapiens
  misc_feature 4, 8, 61, 67, 74, 101, 115, 123, 126, 134, 136, 139, 148,165, 170, 189, 214, 222, 241: n = A,T,C or G
acantagnggatccaaagaattcggcacgaggtttgcttaggcgcagacggggaagcgganccaacntgccagnggcccggagctgggtttgtcgcaaaanttatgtgaccccgnggagaccnttngagaaatntngtntcgaccaanagctgaagctgatcggngagtntgggctccggaacaaacgngaggtctggagggtcaaatttaccntggccaanatccgcagggccgcccggnacctgctgacgcttgatga

SEQ ID NO: 10978 - DNA, 290 bp, Homo sapiens
  misc_feature 7, 9: n = A,T,C or G
aaaccgnangactggagctcgcgcgcctgaaggtcgacactagtggatccaaagaattcggcacgagcaactgccctggagccccagcccctgcgtccatctgtgctgtgcggccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatg

SEQ ID NO: 10979 - DNA, 400 bp, Homo sapiens
  misc_feature 11, 12: n = A,T,C or G
gcgcctgcagnncgacactagtggatccaaagaattcggcacgagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgc

SEQ ID NO: 10980 - DNA, 210 bp, Homo sapiens
  misc_feature 9, 64, 133, 145, 180: n = A,T,C or G
gacactagnggatccaaagaattcggcacgagcccagaacccagggacccttggccccaagctnagctttaagaaccgccccaacccctccagctccaaatttgagcctccaccacatagactgaaactcccntggccccagccntttcctgcctggcctggcctgggacacctcctttntgccaggaggcaataaaagccagcgccggg

SEQ ID NO: 10981 - DNA, 101 bp, Homo sapiens
  misc_feature 16, 25, 33, 38, 42, 55, 77, 92, 98: n = A,T,C or G
aaccgaaatctggagntcgcgcgcntgcaggtngacantagnggatccaaagaanttcggcacgagctcgtgccganttcggcacgaggganaatggngtg

SEQ ID NO: 10982 - DNA, 400 bp, Homo sapiens
  misc_feature 8, 17: n = A,T,C or G
tgtgtgancattgaagntgggacacctagtggatccaaagaattcggcacgaggggaactgggggcattgtgacacccaagtctgatgtgtcctgggttggggggccttcctggagtgtcagggtctctgggcaacgtccattcagggtgcggcatggctgtcacaaagctttatttgagcaaattattttttcactttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatg

SEQ ID NO: 10983 - DNA, 400 bp, Homo sapiens
  misc_feature 5, 6, 45, 90, 95: n = A,T,C or G
ctgtnnttgtgtgaccttgaggtgggacactagtggatccaaagnaattcggcacgagcacaacttcaaaatttagtctgggcctagtgnagtgnctcacacctataatcccaacactttgggaggccaggagttttgagaccagcctgggaaacatctgcctctacaaaaaaatacaaaaattagctgggcatagtggtgcatgccttgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctg

SEQ ID NO: 10984 - DNA, 397 bp, Homo sapiens
  misc_feature 7, 10, 46, 48, 92, 121, 123, 154, 258, 288: n = A,T,C or G
cgctagnggntccaaagaattcggcacgagcatagatactagtagngngctcttttattcaggggaaaatccccccagagggatgggacagngtccactttgcactccaaatgtccccttntnttgctgtccatcagccactaattcacccagngagaggagccagctcacagctaaacagacgcagcagcattttccccttgaacacaactcagtagcctgagctacggggaagggcagaaagtccaagagggattnggtccggggaattggtcaggctgccctggngccatagtctgcctggcatgggagctggctacaccttgtccttcatagccctgacactggggaagtctctcttgttttagaacaagatagaagagcaaatgaatacttg

SEQ ID NO: 10985 - DNA, 225 bp, Homo sapiens
  misc_feature 7, 21, 32, 33: n = A,T,C or G
ccgtaanactggaagtctcgngcgcctgcagnncgacactagtggatccaaagaattcggcacgagcttggcctcaagtgctgggattacaggcctgagccacttgccctggccaaggaactgtggttcttaatccttctggtgcattcaagttgaatgagggagtttataaacagttgcccatccttgggctccaacctgggccacagagcgagactccatctc

SEQ ID NO: 10986 - DNA, 400 bp, Homo sapiens
  misc_feature 3, 4, 29, 43: n = A,T,C or G
atnnagtgggacactagtggatccaaagnaattcggcacgagnagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgc

SEQ ID NO: 10987 - DNA, 191 bp, Homo sapiens
  misc_feature 8, 10, 164, 168: n = A,T,C or G
cctgcagngngacactagtggatccaaagaattcggcacgagctcgtgccgaattcggcacgaggtgacttgggagaaaagggggagcgtggccctccaggaagaggtcccaacggtttgcctggagctataggtctcccaggtgacccaggccctgccagctntggnaaaaatggccgagacggtgagcg

SEQ ID NO: 10988 - DNA, 400 bp, Homo sapiens
  misc_feature 5, 23, 29, 30, 81: n = A,T,C or G
cgtangactggagctcgtgcgcntgcagnncgacactagtggatccaaagaattcggcacgagcatcatgggtcgcatgcntgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgct

SEQ ID NO: 10989 - DNA, 399 bp, Homo sapiens
  misc_feature 5: n = A,T,C or G
cttgnaggtgggacactagtggatccaaagaattcggcacgagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgcta

SEQ ID NO: 10990 - DNA, 400 bp, Homo sapiens
  misc_feature 10, 12, 28, 29, 31, 37, 38, 40: n = A,T,C or G
aaacccgtangnctggaagcctgtgtgnncntgcagnngngacactagtggatccaaagaattcggcacgagcggcacgagctcccataggggtttatatttccctagtgactttgaggcttatcaactctgcatagacaactgctttactttgtggcacgatgccttagttccctttgtgattcagctggagctgctaatgctacccctttatcatgttgctgggccagatgggcctagctccagatgtcagctccaggatattgctgttttctggctgacagtttctacatagccacttctgttcattatgaattggagctgggcgtggtgacacgtgcttgttgtcccagctactcagaaggctaaggcaggaggactatttgagcccaggagtttc

SEQ ID NO: 10991 - DNA, 307 bp, Homo sapiens
gccgccatgatcatccctgtacgctgcttcacttgtggcaagatcgtcggcaacaagtgggaggcttacctggggctgctgcaggccgagtacaccgagggggacgcgctggatgccctgggcctgaagcgctactgctgccgccggatgctgctggcccacgtggacctgatcgagaagctgctcaattatgcacccctggagaagtgaccacgctggaacccacccacccgctgggctgaccatgggccctgagcgtcctaccccgaattcacgaggctgaggcatccgggaactgggcgtaatg

SEQ ID NO: 10992 - DNA, 266 bp, Homo sapiens
  misc_feature 44: n = A,T,C or G
ggatggtgtgaccccatatatgattttctttaaggatggtttanaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaa

SEQ ID NO: 10993 - DNA, 357 bp, Homo sapiens
gtggatccaaagaattcggcacgagggcctgcatcccttaagcctggttctccccatctccagcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagat

SEQ ID NO: 10994 - DNA, 333 bp, Homo sapiens
  misc_feature 2: n = A,T,C or G
gnggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagag

SEQ ID NO: 10995 - DNA, 335 bp, Homo sapiens
ttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagt

SEQ ID NO: 10996 - DNA, 325 bp, Homo sapiens
ttcggcacgagggaaagccgaaaaagaatgctaagaggaataataggaaagccagcgttgatgacaagtgtcttctgtagttgccatcctggtaactcttcagggtgccactattcctctatgcttatggatgtttgaggccttttataggatagaatttcaaaggacaagtagagaagtgttaactcctgggagtagttcgttggttttcccttcatccttttgcctgtacccggcgtggggtggttgtggtgtcggagacaagctcccagaaaggcgcaatgtggctcattccaggcctcaagcaccagaatacgtttagctt

SEQ ID NO: 10997 - DNA, 215 bp, Homo sapiens
  misc_feature 14, 28: n = A,T,C or G
cagataatgaggtnaggagttcgagacnagcctggccaagatggcaaaaccccatctctagtaaaattacaaaaattagctgggcgtggtggcaggcacctgtagtcccagctattcgggaggctgaggcaggagaatcacatgaacccagtaggcagaggttgcagtgagctgagattgcgccattacactccaccctaggtgacagagcgaga

SEQ ID NO: 10998 - DNA, 335 bp, Homo sapiens
ataagccatttctccagttaaccctggttccttcagtggagagtggtatttagaaactataatcttagctttctgagtgctcattgatcctgagtcctcttggtggacagctgggaaatatgtgtatgtctgtgtggggaagtttaaactttccctctgaagagttgatcttgagtctgctggaataagatgacagaagacagattaacaggagaaaaggcatacaagttattcatgtgcaagcgcatgggaattacacaaagtaggaaactcaaagaagtgcttgaataccctcttcacaggggagaggagaaagtgagggatgtaggcaattt

SEQ ID NO: 10999 - DNA, 335 bp, Homo sapiens
cttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttccta

SEQ ID NO: 11000 - DNA, 334 bp, Homo sapiens
  misc_feature 314, 320: n = A,T,C or G
agacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcacctttcacggttttctgtgccaccatcggtcacccattgatcggnccactntgaaccccctggtt

SEQ ID NO: 11001 - DNA, 336 bp, Homo sapiens
ggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactggg

SEQ ID NO: 11002 - DNA, 100 bp, Homo sapiens
  misc_feature 12, 41, 49, 52, 53, 58, 67, 70, 73, 91, 93, 97: n = A,T,C or G
tacaataaggancaaaaagtctggagcttgcgcgcctgcanttcgacantannggatncaaagaatncgnaangaggaagaggtcccaacngnttgnctg

SEQ ID NO: 11003 - DNA, 332 bp, Homo sapiens
gttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtg

SEQ ID NO: 11004 - DNA, 331 bp, Homo sapiens
atttggtccaatctcaactctttaaataaaaaggaattttgcttgaggtaagtaatttagttcctttgtggaaagttctttgacttctaagatgattcagagtttggaattactgatttagtcttctgactgtatcaggagtctttaaatatacattttcaattcaattaataagtcatgagttcagttaatttatcatcagtgcaatcagaaaccatcaaagtagactgagttgccagcctttacttctggctaatcctgacacatttcacatgtcatggattcctgaaattctgaagctgagattgctaatggttcagattggttactg

SEQ ID NO: 11005 - DNA, 335 bp, Homo sapiens
ctggtgcaggcacaaggagttcatgataaggctacatttttatagtctttttcatgagagatcatagtatttactttttcatttacatgagatatttattttcttacagtagtttcacttctaatgcaaatctatttaaaccatataataaagcatagctgtcaggggccaaaccagatgaatgggtgtcaacttgcctgatacattacctattaaagtgcaaattgttatctatttatttctcaagaaataacttcaattcttacataatacataacaaatcagccaggtgcagtggctcacacctatagttccagcactttgggaggctgagg

SEQ ID NO: 11006 - DNA, 102 bp, Homo sapiens
  misc_feature 13, 25, 30, 33, 50, 54, 73, 84, 86, 98: n = A,T,C or G
agtctggagcctngcgcgcctgcanttcgncantacgtggatccaaaganttcngcgcgataaagatctgccngagtacttgtntngatttggggaantggt

SEQ ID NO: 11007 - DNA, 100 bp, Homo sapiens
  misc_feature 12, 28, 40, 48, 85, 87, 97: n = A,T,C or G
taccataaggancaataatctggagctngcgcgcctgcanttcgacantaaaggatccaaagaattcatcacgagctttaaaaanantagccccctnatg

SEQ ID NO: 11008 - DNA, 332 bp, Homo sapiens
gtgaacttgacaaccacaatggctgcttccattcatcacatgttcgccatcacacacaatcagacattgtaaaacatctcaactcttagtgttttgttattgatattttaaaaaatgctttagcacaatgtattactgattctgttacatatgtataatttccatagcaaaaattcaatttgtcttaaaacattaatcaacaaatgaaactaggtactaattttcctacctttaatgaaacaaataattatcttaatctggaagagataaaactttatgggaaaatatcttctaaaaaatctataatttgttttaaacacaataacactact

SEQ ID NO: 11009 - DNA, 333 bp, Homo sapiens
  misc_feature 105: n = A,T,C or G
cagagactgatctttgctggcaagcagctggaagatggacgtactttgtctgactacaatattcaaaaggagtctactcttcatcttgtgttgagacttcgtggnggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaac

SEQ ID NO: 11010 - DNA, 400 bp, Homo sapiens
  misc_feature 9: n = A,T,C or G
gaacaaaanctggagctcgcgcgcctgcaggtcgacactagtggatccaaagaattcggcacggtttgtgagatatgatcttcctttttaagagttctttatacttttcagagcattttcatacactctgagagtctcataacatgtatttttatctctttttaaagatgaggaaaggactgatgcttagagacgttgaataacataaataaaatcccagcaaacatttagtatgccttggccgggtgcagtggctcacccctgtagtcccagcattttgggaggctgaggcaggtggctcgcttgaagtcaggagtttaagaccaagctaaccaacatggtgaaaccctgtctttactaaaaatacaaaaatcagcccggcatggtagtgggcgcctgt

SEQ ID NO: 11011 - DNA, 108 bp, Homo sapiens
  misc_feature 11, 39, 45, 47, 51, 65, 68, 83, 86, 87, 88, 90, 97: n = A,T,C or G
tacaaaagaanaaaagtctggagcttgcgcgcctgcagntgcganantagnggatccaaagaatncgngacgagctgtcccancannncnacctggnggctctttcca

SEQ ID NO: 11012 - DNA, 333 bp, Homo sapiens
gttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgcttt

SEQ ID NO: 11013 - DNA, 123 bp, Homo sapiens
ctctgagcaagacagtgcgcttcaacgtgctcaaggtcaccaaggctgccggcaccaagaagcagttccagaagttctgaggctggacatcggcccgctccccacaatgaaataaagttattt

SEQ ID NO: 11014 - DNA, 104 bp, Homo sapiens
  misc_feature 9, 29, 41, 52, 77, 81, 82: n = A,T,C or G
tacaataangaacaataagtctggagctngcgcgcctgcanttcgacactanaggatccaaagaattcggctcgagncatnnttgctttgttgcttattcgcct

SEQ ID NO: 11015 - DNA, 335 bp, Homo sapiens
gcctggccaattctttagggccaacttctggctcctttcccaacttcttcatcccttggggatctctagaatcagtgccaagcacatagtaaatgctcagtaaatactcattgcaagaatagactcctaggctgtactgccttgtgacatgtccttttgcttactgttgcctgatgactcggaagttctgtgtacgtggttttagctcctcacctggttgacaatgagcagcaggcaaggagtgggaaatgaacacacagggagaccgatcgctgagaacaccgacagttcccctctctctaccagagcccacaggcgggtttggtgagctgctt

SEQ ID NO: 11016 - DNA, 100 bp, Homo sapiens
  misc_feature 4, 24, 29, 33, 34, 53, 54, 64, 67, 80: n = A,T,C or G
gganagtctggagcttgcgcgccngcagnaggnnactagaggatccaaagaannggggacgagntgntctcttatactanaatccttaattagttttatt

SEQ ID NO: 11017 - DNA, 128 bp, Homo sapiens
  misc_feature 42, 49, 57, 110: n = A,T,C or G
gtggatccaaagaattcggcacgagggctcactacacagccnttggggnacaactgngtgcatgggcagaaacagcaagtgccctcattgtggtcacttgggtggggagngccttttgtcaaggagtc

SEQ ID NO: 11018 - DNA, 335 bp, Homo sapiens
  misc_feature 281, 314: n = A,T,C or G
aagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaaagaagtactccaagaacaatctgcttttttcatcatttgttttatgaatttatccatgtttgcttaatgcttctgctaagtgttagccaaaatctagccatttatatttaaggttgngtaaacctaaattaaatgctgtagtatttttgngggaatgtactatatagcaag

SEQ ID NO: 11019 - DNA, 337 bp, Homo sapiens
gtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctt

SEQ ID NO: 11020 - DNA, 335 bp, Homo sapiens
  misc_feature 244, 252, 288, 301, 332: n = A,T,C or G
cgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggnaaaaaatnctgctggacgcacagcatgagtctggacgggagtancttccaagagctntcactgggacagcccaccttgctcgcagacncca

SEQ ID NO: 11021 - DNA, 100 bp, Homo sapiens
  misc_feature 12, 30: n = A,T,C or G
tacaataaggancaaaaagtctggagcctngcgcgcctgcacttcgacactacgaggatccaaagaattcagtactagcaattattgctgggggactgtg

SEQ ID NO: 11022 - DNA, 337 bp, Homo sapiens
atatcacagtgctacagagattttgtttatggccggtttgggggccagtttatggccagatttgggggcctgttcccaacacttactggcagggactgcctcacattataaggcctcaaaactgctagatactttgccaacacccctccccccacctcctttaaacctaggggtggacatgtgacccagttctggataatggaacttagggaggaagttttctggaagattctgcaaaggattttcctccctaatgcaataaatatgcttagggagaaatctttaattccttcttttttttctttttttgagatggagtctccctctgtcacccagg

SEQ ID NO: 11023 - DNA, 335 bp, Homo sapiens
tgttcacatccagttgtctaaaggatgagatttttcatgtatcttatagtcactcattcttcggtctgaattttagacgatcacagaaacggtctttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttg

SEQ ID NO: 11024 - DNA, 362 bp, Homo sapiens
cctgcctcggcctcccaaagtgctggcattacaggcatgagccactgcacccagcccacagacagtcattagtaagtattctcttgtaagttttcctaacaattaacatctgtgtacattggttttcttgctaaacttaactctaatttttgccagtactaatatgtagtatccactcatagtttttaggacttcaaaatctgagtgtattgggtatatggtatcagcgtcagcattcatatgaagcctgagagtcctttctgtgtgtcaagtcaggaggtgtaggtgtaggaaatgctgatccaggtaggactgtttggcacctagcaggtactcaagaaatgtttactggaaaatgttaa

SEQ ID NO: 11025 - DNA, 103 bp, Homo sapiens
  misc_feature 4, 33, 41, 45, 60, 72, 77, 81, 83, 92: n = A,T,C or G
ggancaaaaagtctggagcttgcgcgcctgcanttcgacantagnggatccaagaattcngaacgagcgagnacggngtgngnccttgaatnctgtgttgcat

SEQ ID NO: 11026 - DNA, 128 bp, Homo sapiens
gagcgcttctatgtgaaagcaaagaaataattttaatactctggcattcataaattttattgatgagattatttattttaaaggtttgaggtaacatctctggttgtaccaaagaagaaataaatatg

SEQ ID NO: 11027 - DNA, 288 bp, Homo sapiens
  misc_feature 244, 250: n = A,T,C or G
gacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggnccggcntcccaaaaaccccatgtgtgtacgattaaaaaggttgg

SEQ ID NO: 11028 - DNA, 287 bp, Homo sapiens
gtggatccaaagaattcggcacgagcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcacc

SEQ ID NO: 11029 - DNA, 248 bp, Homo sapiens
  misc_feature 157, 177, 215, 223, 231: n = A,T,C or G
agtccaggaagttgagggtgcaatgagccatcatcataccactgtactccagtctgggagaagggagtgaaaccttgccttaaaaaacaaaaggaggccgggcgcagtggcctgtaatcccagcactttggggaggctgaggcaggtggatcacgangtcaggaggtcgagaccatnctggcttaacctccgtgccgaatttcggcacgaggctnttgaaaanactggtcnttgaaatcaataccccc

SEQ ID NO: 11030 - DNA, 209 bp, Homo sapiens
  misc_feature 6, 60: n = A,T,C or G
aaattntgtaatgcaaaatttttttaatcttcgccttaatacttttttcttttgttttanttttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcac

SEQ ID NO: 11031 - DNA, 334 bp, Homo sapiens
gtttcattgcattgtctgtgaagtataatttctgggccagaattgctcagttgcatttgatccaggactatagattggaaatgggtcatcattgttttctgttgtgattatagccattctagtaggcgtttaaggtcatggcctgcagaaaatgatgtaagaactagttcttaatctttcagatcaagctaatgatgatatggaaccttgagttcgaattgattggtttacttggaaaaaaacatgtttgaaaattgcaaaagttccgccgggcgcggtggctcatgcctgtaatcccagcactttgggaggccgagacgggcggatcacgagg

SEQ ID NO: 11032 - DNA, 100 bp, Homo sapiens
  misc_feature 6, 23, 35, 38, 40, 47, 64, 69, 71, 78, 80, 89, 98, 99: n = A,T,C or G
aaggancaaaaagtctggagctngcgcgcctgcanttngncactagnggatctcaaagaattcnggacnancgggacnanctgaatttnaaacctggnna

SEQ ID NO: 11033 - DNA, 100 bp, Homo sapiens
  misc_feature 6, 22, 34, 36: n = A,T,C or G
aaggancaaaaatctggagctngcgcgcctgcantncgacactacaggatccaaagaattcggtacgagggtacaacggtatgaaaatctgcacgaaatg

SEQ ID NO: 11034 - DNA, 100 bp, Homo sapiens
tctggagcttgcgcgcctgcagttcgacactagtggatccaaagaattcgttacgagctttgacaaagagcgggcggacccgcaggaccactaggatgct

SEQ ID NO: 11035 - DNA, 102 bp, Homo sapiens
  misc_feature 5, 20, 34, 36, 51, 93, 95, 96: n = A,T,C or G
taccnccttaaccccagaanatttgccgccttgnanccttaagagctacanatctagaaaccttgacgggggggagagagggttctaaggctntnntagcgt

SEQ ID NO: 11036 - DNA, 101 bp, Homo sapiens
  misc_feature 15, 23, 27, 32: n = A,T,C or G
aaaagtctggagctngcgcgccngcantaggncactagaggatccaaagaattcgggacgagcggaacgagtgaacatcttaccatcctggacttattccg

SEQ ID NO: 11037 - DNA, 276 bp, Homo sapiens
  misc_feature 202, 245, 248, 269: n = A,T,C or G
ttcggcacgagagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaancgagggctgatgaggtgacctggagtgaggggcggtgccttcnccncccctcaggaaccattacttnaggggtt

SEQ ID NO: 11038 - DNA, 324 bp, Homo sapiens
  misc_feature 152: n = A,T,C or G
gagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggnggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagacctgttg

SEQ ID NO: 11039 - DNA, 335 bp, Homo sapiens
ggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggcttcca

SEQ ID NO: 11040 - DNA, 334 bp, Homo sapiens
gctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaata

SEQ ID NO: 11041 - DNA, 219 bp, Homo sapiens
ggcaggtggatcgcctgaggtcaggagttcgagtccagcctggcgagcatggtcaaaccccgtctctactaaaaatgcaaaaattggccgggcatggtggcaggcacgtgtcaggaagctgaggcaggagaatcgtttgaacccgggaggcggaggttgcaccaagccaagatcgcgccattgcactccagcctgggcaacagagcgagactccatctg

SEQ ID NO: 11042 - DNA, 113 bp, Homo sapiens
catttctgtccaattgaatacttaattgtaacgatgatggttacccttcatggacgtcttaatcttccacacacatcccctttttttggaataaaatttggaaaatggaaatg

SEQ ID NO: 11043 - DNA, 102 bp, Homo sapiens
  misc_feature 6, 20, 32, 34, 35, 40, 44, 68, 69, 79, 86, 88: n = A,T,C or G
aagaanaaaatctggagctngcgcgcctgcantnngacantagnggattcaaagaattcggcttgagnncttctcggcntcatggncncccttagacccctt

SEQ ID NO: 11044 - DNA, 101 bp, Homo sapiens
  misc_feature 1, 10, 22, 28: n = A,T,C or G
nctggagctngcgcgcctgcantatcgncactagaggatccaaagaaattcggaccgagagactatgcacctttgggtcgctttggtgatcgggatatcag

SEQ ID NO: 11045 - DNA, 101 bp, Homo sapiens
  misc_feature 8, 11, 40, 44, 48, 52, 57, 83, 97: n = A,T,C or G
acaataangancaaaaagtctggagcttgcgcgcctgcanttcnacantaanggatncaaagaattccgcacgagcgtccccntgctcatagggtantggg

SEQ ID NO: 11046 - DNA, 326 bp, Homo sapiens
cgcaaacaggtggaggtcttcaggcagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgat

SEQ ID NO: 11047 - DNA, 251 bp, Homo sapiens
gtaaaccacacgaagaatcaacacaagtataatcataatgattgttgcagctaataattcattagagaagtgattatgttaacaacagaaacgtcacagttgattgactactgattgcattcacatgaaggtccagtacttttgttggtgtaatattgccctctgatcttttacaaaatctgggatctgaatcattcacatcttgagctgtacccaggaagttacatgctacattcacatttccaatggtt

SEQ ID NO: 11048 - DNA, 108 bp, Homo sapiens
  misc_feature 11, 15, 27: n = A,T,C or G
gaaagtctggngctngcgcgcctgcanttcgacactcgaggatccaaagaattccgcaccagcaaacctgttagttgacaaagtgaccttgctggcttaaaggttctg

SEQ ID NO: 11049 - DNA, 335 bp, Homo sapiens
attttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggcttgtgcctcagacagtg

SEQ ID NO: 11050 - DNA, 335 bp, Homo sapiens
  misc_feature 303: n = A,T,C or G
gatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggngaaaggttctaaagacgtggggatcgtttcca

SEQ ID NO: 11051 - DNA, 329 bp, Homo sapiens
cccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagc

SEQ ID NO: 11052 - DNA, 330 bp, Homo sapiens
gtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcacc

SEQ ID NO: 11053 - DNA, 334 bp, Homo sapiens
  misc_feature 202, 241, 280, 296, 317: n = A,T,C or G
gtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggntttggctggggttggtctgaagcctgcacgcggcagttntttgttaaagatctgagggactcctcagtcctggggcgncgccgcctgcagcctnttccaagcccctgggtccagngagcgtcacagcacaac

SEQ ID NO: 11054 - DNA, 105 bp, Homo sapiens
  misc_feature 4, 21, 33, 44, 82, 88: n = A,T,C or G
ggancaaaaagtctggagctngcgcgcctgcanttcgacactanaggatccaaagaattcgtgacgagctgccacgcaggcnaggagntttcacactcaggcacc

SEQ ID NO: 11055 - DNA, 334 bp, Homo sapiens
ccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaaccttgggagac

SEQ ID NO: 11056 - DNA, 336 bp, Homo sapiens
gccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattc

SEQ ID NO: 11057 - DNA, 100 bp, Homo sapiens
  misc_feature 10, 24, 32, 36, 37, 40, 42, 93: n = A,T,C or G
aaaaggaacnaaagtctggagctngcgcgccngcannatngncactagaggatccaaagaattcgggacgagcggagcgacaaaggacccaantacttta

SEQ ID NO: 11058 - DNA, 333 bp, Homo sapiens
gttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttaaggtcaccagccgggcagggtggaaggagcttgcctctttgagaaaccaaggagtcccagtgatctgttaccatttggttatgacttctaaagagccaaatgctattccttcaagcctgttttgcaggcagaaaata

SEQ ID NO: 11059 - DNA, 332 bp, Homo sapiens
  misc_feature 316: n = A,T,C or G
gtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcatttggggtgctggatgagggcaagatgaaanctggattacatcctgg

SEQ ID NO: 11060 - DNA, 324 bp, Homo sapiens
  misc_feature 153, 207, 249, 252: n = A,T,C or G
ttcggcacgagcaaagggcctaagggtgaaaacggtgttgttggtcccacaggccccgttggagctgctggcccagctggtccaaatggtccccccggtcctgctggaagtcgtggtgatggaggcccccctggtatgactggtttccctggngctgctggacggactggtcccccaggaccctctggtatttctggccctcctggnccccctggtcctgctgggaaagaagggcttcgtggtcctcgnggngaccaaggtccagttggccgaactggagaagtaggtgcagttggtccccctggcttcgctggtgagaagggt

SEQ ID NO: 11061 - DNA, 100 bp, Homo sapiens
  misc_feature 16, 52, 71, 96: n = A,T,C or G
gcgcgcctgagtaggncactagaggatccaaagaattcggctcgagcattcntcgatgtggcccccttggncgttggagccccagaccaggaattnggct

SEQ ID NO: 11062 - DNA, 100 bp, Homo sapiens
  misc_feature 24, 36, 39, 47, 55, 62, 64, 75, 90: n = A,T,C or G
aaaaggaaaaaaagtctggagctngcgcgcctgcanttngacactanaggatctnaagaatncngaacgagcganagaacgaggggacgnaacggaggca

SEQ ID NO: 11063 - DNA, 252 bp, Homo sapiens
  misc_feature 192: n = A,T,C or G
ggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggngagtggaatttgacattgtccaaacctttttcatttttgagtgattaaaaatgaaatgtc

SEQ ID NO: 11064 - DNA, 368 bp, Homo sapiens
cccaaacccactccaccctactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaacttta

SEQ ID NO: 11065 - DNA, 337 bp, Homo sapiens
gctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttcca

SEQ ID NO: 11066 - DNA, 337 bp, Homo sapiens
cgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagg

SEQ ID NO: 11067 - DNA, 100 bp, Homo sapiens
  misc_feature 12, 28, 41, 58, 84, 87: n = A,T,C or G
tacaataagganggaaagtctggagctngcgcgcctgcagntcgacactagtggattnaaagaattcggaacgaggaacagagnggnctacatggaccag

SEQ ID NO: 11068 - DNA, 113 bp, Homo sapiens
  misc_feature 4, 20, 62, 67, 69, 72, 79, 83, 95: n = A,T,C or G
gaanaaaaagtctggagctngcgcgcctgcaggtcgacactagaggatccaaagaattgggnacgangnttnctaccgnattngaattcaatgantattttctcattaccttt

SEQ ID NO: 11069 - DNA, 100 bp, Homo sapiens
  misc_feature 12, 13, 30, 42, 43, 48, 49, 51, 55, 56, 61, 71, 73, 74, 76,85, 96: n = A,T,C or G
tacaataagganngaaaagtctggagcctngcgcgcctgcanntgcgnnantacnnggatncaaagaaatngnncncgagcctcntgccgaattcngcac

SEQ ID NO: 11070 - DNA, 322 bp, Homo sapiens
agggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgag

SEQ ID NO: 11071 - DNA, 357 bp, Homo sapiens
  misc_feature 257: n = A,T,C or G
ctcgtgccgaaaaatcttgaatacaaaacactacctgcattattaactgtagtcttcatgttgtacattagatctttccacttgctcaacctacatatttgctactttgtatctcctcttttttcctccccactgccaccccctaccctggtaaccactgttttactctctctatatatatatttgcccttttaaacaaaagattccacatataagtgagagcatgaaacatttttctttctgtttctggcttattncacttaacataatgtcctctaggtccatcaggaaacctattttaattataaatgcaacttccaagaacgtctaaaataattatattccattttccccaag

SEQ ID NO: 11072 - DNA, 320 bp, Homo sapiens
atgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatattgt

SEQ ID NO: 11073 - DNA, 339 bp, Homo sapiens
cggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgt

SEQ ID NO: 11074 - DNA, 283 bp, Homo sapiens
tccaggcccagtgccaggagaacccccatcaaaggaagacagtgtggagcagataaggtggggaaggagaagggtcgtctctgagcacggagcaggctggtcctgccttgacccagcccggtggctcttactctcgccaggaacaggctccgacgagatcttcctggcaccctgagggtcgtcctccagcaggggcttcttggacccctgtctgaggggtcgcgtcttagtgggcgggattcttttccctttgaataaaaatggattcaaacccagcattagg

SEQ ID NO: 11075 - DNA, 309 bp, Homo sapiens
gttttactaagacctttaaatctgacttcttggctgggcatggtggctcacacctataatcccagcactttcggaggctgaggcgggtggatcacgaggtcaggagttcgagaccagcctggccaatatggtgaaaccccatctctactaaaaatacaaaaattagccgggcgtggtggtgcgcagtctgtggtcccagctactcaggaggctgaggcagaagaatcgcgtgaacccaggaggcagtggttgcagtgagccgagatcgcaccactacactccagcctaggcgacaagcaagactgtctt

SEQ ID NO: 11076 - DNA, 233 bp, Homo sapiens
cttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccag

SEQ ID NO: 11077 - DNA, 329 bp, Homo sapiens
gctgatggagtgatgttgtgggcacaaggcatctgtcagctgcctcctttaacagccatgccttctggaatctggaagaggacaccactcctgcagtcaccgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactg

SEQ ID NO: 11078 - DNA, 331 bp, Homo sapiens
atttaacactgtggatttttattaactaggatctttatttcaaaggacagcctacatttcaagtaagtaataactaccttgtttaacaaacaacatcaacaaataacttaaaacatatacaaagaaagcaaaaggcaaatcttcctttttagaagcaagtactataaccagtttcctctggatcccttcagagattcaaatacaattaacttgtatttaagttaaaattggttgcttttttaaaatgtacgatttttagaggagcagaatgtgggaagtaaacaataatttggacgaaactccaagtagattttataagatttctctaaat

SEQ ID NO: 11079 - DNA, 365 bp, Homo sapiens
cgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagcttgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagccccgcgtcgaggtgga

SEQ ID NO: 11080 - DNA, 338 bp, Homo sapiens
ggattactggtgtgagccaccgtgcctggccatactttttatttttaatataaaagtacgttagagatcatgtatacgtttgtccttaaaatgaaagtttagataccagtgcaggttaaagtctcttacatcacatatattaccatttctgccataatttattctgaatctaaaatggagatgatttacacatttgaaaagtgttgaacttttaaatgtaacataatatataagataaggtggcaggtgtaagatagagcagtgttcgtaggctatcggagatgaggctttgccactaaatgtagatgctgttaggaaaaagaatccatttgtaatac

SEQ ID NO: 11081 - DNA, 107 bp, Homo sapiens
  misc_feature 9, 70, 93: n = A,T,C or G
gaaaaactngagaatcatgttgaagctaaacccatatgcaatagtaccatgcgccggaacaccattcttngccaggccaggaatcacaagctncgggtggataaggc

SEQ ID NO: 11082 - DNA, 327 bp, Homo sapiens
aatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgagg

SEQ ID NO: 11083 - DNA, 365 bp, Homo sapiens
  misc_feature 25: n = A,T,C or G
cagacctgggatgtggtgatacttnctcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcgtcagcacaccaaactctgaattcaatcccctgtttccatcag

SEQ ID NO: 11084 - DNA, 339 bp, Homo sapiens
cgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttcacacaacccgctg

SEQ ID NO: 11085 - DNA, 353 bp, Homo sapiens
gtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaaatttttttcttcgcaggatttttctgagccttttaccactccagcctagcccctaccccccaattaggagggcactggcccccaacaggcatcaccccgctaaatcccctaga

SEQ ID NO: 11086 - DNA, 330 bp, Homo sapiens
ccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctt

SEQ ID NO: 11087 - DNA, 331 bp, Homo sapiens
ttcgtgttcactttaagaacactcgtgaaactgctcaggccatcaagggtatgcatatacgaaaagccacgaagtatctgaaagatgtcactttacagaaacagtgtgtaccattccgacgttacaatggtgggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagag

SEQ ID NO: 11088 - DNA, 180 bp, Homo sapiens
  misc_feature 2, 180: n = A,T,C or G
gngcattcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagcctctgctccctctgaaaaaaaaaaaan

SEQ ID NO: 11089 - DNA, 335 bp, Homo sapiens
tgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtgggtgtgt

SEQ ID NO: 11090 - DNA, 360 bp, Homo sapiens
agagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccag

SEQ ID NO: 11091 - DNA, 309 bp, Homo sapiens
  misc_feature 302: n = A,T,C or G
aaacacaccagccaggaacggcactcacacctgtaatcccagcactttcggaggccaggcggtaggatggcttcagaccaggagtttgagactagcctgggcaacatggcagactccatctctacaaaaaatgaaacaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctntttttta

SEQ ID NO: 11092 - DNA, 336 bp, Homo sapiens
ggacatttgggagccatcagaatttctaagcagggagtaacaccaggagaactgtcttctagaaggaccactctggggcagtgaggtggagtgacctgtcaggatgctgtggccacagtctagagggagacgctgggggcctggtgggagggtggagagaaaagagcagattggtgagacatcatgatgtaaatttgacagcactaagtatctatctttgtagggtgatccaggagctgcaggacagaagggccaggcaggagagaaggggagagccggcatgcctggtggacctggcaagagtggttccatggggccttgttgggcccaccgggc

SEQ ID NO: 11093 - DNA, 334 bp, Homo sapiens
agctgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaatttagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgc

SEQ ID NO: 11094 - DNA, 332 bp, Homo sapiens
aaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacatta

SEQ ID NO: 11095 - DNA, 350 bp, Homo sapiens
gctaaattggcatctatctagtgcaagatttctcattttatgggaaagacaatgcattgtggattaagatgatgtagatttgaatcccagtgatcttggaatttgaatctcagttgtgtcatttggaaaaacctttaacttcagtcatcacagagctgcagttctcaactggggcaatttgtccttccgcctatgtccccagaagacatttgataacatctgaaaacatttttggttgttacaaccagggtgagggtgggaggagttgttaatgtcatctctggtgggcacaactcagggatactaaccatcctatgatgcacacaacagccccccacaacaaacaatca

SEQ ID NO: 11096 - DNA, 191 bp, Homo sapiens
  misc_feature 123: n = A,T,C or G
ttcggcacgagccgtgcctggccttctatgccttattttaaaaatgggtaataatagcaactaaatttagttcctgatttttatagtccatgttagcctgttcagtgcattaaagaaaacagnggaggttgcaatgagccaagattgcaccactgcactccagcctgggggacagagcgagactctgcctc

SEQ ID NO: 11097 - DNA, 353 bp, Homo sapiens
cccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacatt

SEQ ID NO: 11098 - DNA, 360 bp, Homo sapiens
tttctattttggccagctatttgtatgatttatactgacccttcctgtttcagtttattcagctataaaatgaggctatactttctgcttagttggcttcaaggttgtgattttcaaaagattttgccttgtttcagctgattttgtatggtatgctgggaaaaggtgcataggagaaggatgagttgatagacttcagttctagtctgaaatcaacttcatacttgatcttccattcttgactccagaaggttccctgtaaagtccaccgttcaagatggatctgccatttctccacttgcaaaatggaaataagaatgatctctattacactatctttgtatgtgattgtagatactg

SEQ ID NO: 11099 - DNA, 332 bp, Homo sapiens
ggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgc

SEQ ID NO: 11100 - DNA, 333 bp, Homo sapiens
cctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtactttgtaaaaagatttcaagttattaggaagcatactctgttttttaatcatgtataatattccatgatacttttatagaacaattctggcttc

SEQ ID NO: 11101 - DNA, 293 bp, Homo sapiens
caaaagttggcccggcatggtggctcacacctgtaatcccagcactttgggaagctgaggtggatggatcacctgaggtcaggactttgaaaccagcctggctaacatggcaaaaccccatctctactaaaaaaatacaaaagttagccgggcatggtggcatgcgcctgtagtcccagctactcgggaggctgaggcagaattgcttgaatccgggaggcagaggttgcagtgagctgagatcacacaactgtgctccagcctgggtaacagagcaagattctgtctcaaat

SEQ ID NO: 11102 - DNA, 336 bp, Homo sapiens
gggaccttgagtgtctgacggtgaagttatcataagctagttcccagagcagaacatgggtggtccctgtagcttggtcctcccaggagtctcggatgtaaggttagcagtcctgctgttaattctgtcacaaattttggacatattttcctttctcatatctggagaaagaatacatagtcaaggtcagtcctataaaaacaaataaccatgaggtaactctcaatatgtgggtttccctggttctggaattctgcttgcttcactgttaatgtcagcatttgtcagtcatttcccctccggttccctggttggaggtcaaagaaggtgaagcca

SEQ ID NO: 11103 - DNA, 348 bp, Homo sapiens
ctgcactgacatcgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcac

SEQ ID NO: 11104 - DNA, 145 bp, Homo sapiens
agacggcgcttcagagtttcctttccagacacccctccccgcactgtgaagttcccctgaccgccctcctggttcacaaagagcattaagaaagctgcggtggtctgagcaacatagcccagaggctgagcctcctggcctgcct

SEQ ID NO: 11105 - DNA, 333 bp, Homo sapiens
gaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaacctttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttctt

SEQ ID NO: 11106 - DNA, 338 bp, Homo sapiens
ccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaacctttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatt

SEQ ID NO: 11107 - DNA, 338 bp, Homo sapiens
aggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaag

SEQ ID NO: 11108 - DNA, 333 bp, Homo sapiens
ggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccat

SEQ ID NO: 11109 - DNA, 341 bp, Homo sapiens
  misc_feature 30, 296: n = A,T,C or G
cccgagcgccgttccggtgcaccggctcgntccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgccttggaggtggaggggaagatggtcagtaggacagaaggtaacattgatgactcgctcattggtggaaatgcctccgctgaaggccccgagggcgaaggtaccgaaagcacagtaatcactggngtcgatattgtcatgaaccatcacctgcaggaaacaagtttcaca

SEQ ID NO: 11110 - DNA, 353 bp, Homo sapiens
aagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcagg

SEQ ID NO: 11111 - DNA, 328 bp, Homo sapiens
gcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacg

SEQ ID NO: 11112 - DNA, 358 bp, Homo sapiens
ctgcactccagcctgggcgacagagtgagactccatctcaaaaaaaataaaataaaataagaatctatacccaaagcaaacatgctaaataaaaacatcagaaaataagttaattggagagaaaaatcaaagagaataaaatacatgaaacattttgatcaaaacaatgaaacaggccaggcacagaagctcacacctgtaatcccaacactttgggaggccaaggcaggtggctcacttgaggtcaggagttttagaccagcctggccaacatggtgaaacgctgtctctactaaaaatacaaaaattagctgggtatggtggtgggcacctgtaatctcagttacttgggaggctg

SEQ ID NO: 11113 - DNA, 102 bp, Homo sapiens
gagaactagtctcgagagtacttctagagcggccgcgggcccatcgattttccacccgggtggggtaccaggtaagtgtacccaattcgccctatagtgagt

SEQ ID NO: 11114 - DNA, 363 bp, Homo sapiens
gtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggc

SEQ ID NO: 11115 - DNA, 348 bp, Homo sapiens
gctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtg

SEQ ID NO: 11116 - DNA, 324 bp, Homo sapiens
caaaaccagggtccatactgcttgcctccagaggcggcttcaggcctcactaaaggtcaggcagtcctgctgagcaggagggagaggaagggggtcctgtaggacgggcaggatggtctgggcctgctcctccttcctctgcccctctgccactccacactccagcacagggctgggacaggggcttggagttcctgcagtggcggccacacttccctccctccctcccttcctcaggagccgccagtccccaagttggctgtggttgggcacctggtttgggtcctgcagagctgggctcaggccctgggctctgaacctgtg

SEQ ID NO: 11117 - DNA, 124 bp, Homo sapiens
gcttgtggtaccagctgcacgggaggctgagtggggaggatcagttgagcccaagaatttgaggtggcagtgagctatgactgtgccactgcactccagcctgggtgacagagcaagaccatgt

SEQ ID NO: 11118 - DNA, 229 bp, Homo sapiens
cagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgagg

SEQ ID NO: 11119 - DNA, 338 bp, Homo sapiens
  misc_feature 258: n = A,T,C or G
tcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggnggacctgctccagcagcttggtgcttgcaccagcaaggaggtcctgcccccttccactgctgctgctccagcttgaggag

SEQ ID NO: 11120 - DNA, 356 bp, Homo sapiens
  misc_feature 300: n = A,T,C or G
ggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttgggggtttggtttttgntctgaactttcctgttaccttttcagggctgacgtcacatgtaggtggcgtgtatg

SEQ ID NO: 11121 - DNA, 358 bp, Homo sapiens
gcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccggggtggttaaacttcgcaaaatgcctagatattatccta

SEQ ID NO: 11122 - DNA, 360 bp, Homo sapiens
gcatttttaacaaaaattgccagctttctagctgaccactcaagagcatgagttttccccactcggtgaaatttatgttgtataacgcagacctcattcaataattgatcagaaaatgtaactgagaggagtgattatttttggaaacattgacgaccaataacccaagatacaaagttagaaaacattgccatttaaaaccttgtagataccggaattcttgtgagtccccttatccaggtacatgttaggtcttgagttaattgctctgtggctgtggatttttatttgatgttctgatctcttccttccagtttgataaattagtgtagaaagtggaagaaaaacatgccggcgcag

SEQ ID NO: 11123 - DNA, 330 bp, Homo sapiens
  misc_feature 317: n = A,T,C or G
gctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgnttttttccctctc

SEQ ID NO: 11124 - DNA, 336 bp, Homo sapiens
  misc_feature 214: n = A,T,C or G
ccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccanaaacagccctagtcccaactccttgcgttcctttggcccctccctgcctacctagaatctgcctgaaagggctggagaggggcagtatttggggggactgtgctagctttacccccgcagga

SEQ ID NO: 11125 - DNA, 333 bp, Homo sapiens
ggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgacttggagtggccagtgccctgtcctccagataccactgagctcactgc

SEQ ID NO: 11126 - DNA, 362 bp, Homo sapiens
  misc_feature 28, 35, 82, 100, 306, 327, 347, 356, 359: n = A,T,C or G
aataataccgtgtaccccatggagcggntggtggncgacaagctcattttccacaactcttgcttctgctgcaagcactgtnacaccaagctcagcctgngcagctacagccgcgctgcacggtgagttctactgcaaaccccacttccagcagctgtttaagagcaaaggcaactacgacgaggggtttggccgcaagcagcacaaggagctctgggcccacaaggaggtggaccccggcaccaagacggcctgaggcctcttgtaaccttccacccccctctgcggaaggcctggagccggcangggggaaggtgggaaggaggncgagctgggctttgcgtggnggccaaggnggnaag

SEQ ID NO: 11127 - DNA, 252 bp, Homo sapiens
gctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcagg

SEQ ID NO: 11128 - DNA, 373 bp, Homo sapiens
  misc_feature 13, 15, 37, 41, 43, 57, 59, 60, 77, 113, 120, 155, 162, 169,226, 292, 328, 330, 335: n = A,T,C or G
ctgctgcccactnanaagcttcatcaggtggcctgtnctgnanatgagcttggacangnnacttgcacatgggcccnagagcagtccatcttcaaggtcctggataacatganaaatganccttctcacattgttggggataagggactgtagcntgctggnttagctngaatttcaaactgagcaatgggtaattgaagcttttgggctcgggggacaggtcagngcccacgttgctgtattcccattttgtctcagtttgtttaacagttggccctaagttgaatgcagncccagcggaatctgcctcaggaggatgattgtaggntngtgtnttcagagatggtgacttctggcatgttagtgttttcca

SEQ ID NO: 11129 - DNA, 332 bp, Homo sapiens
  misc_feature 274: n = A,T,C or G
ctgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggnttatggatacaatgctgcctataatcgctacttcaggaagcgccgaggggccaaatga

SEQ ID NO: 11130 - DNA, 183 bp, Homo sapiens
  misc_feature 13, 95: n = A,T,C or G
gtggatccaaagnaattcggcacgagctgaatatatacaggtatattaagagtacactccaagccaacacacttgtcatgagctatttatgaccntagctgcatgattcttgctactcaaggtgtggtctggggaccttgtaagaaatacagagtattatcaggatctgggaaaatttgaaat

SEQ ID NO: 11131 - DNA, 243 bp, Homo sapiens
  misc_feature 9, 23, 59, 119, 213, 219: n = A,T,C or G
ctggagccnagggggagcctggncccatggggatccctggagtcaagggccagcccggnctttctggtcctcctggccttccgggccctggttttgctggacctcctgtaagtcctcanggatggggcaggatccccagaactcccagggaaggaggggacaacagaaaggcttcgagggaatggccaccatgggaaggagccagcttgctgngatagngtcaggaataagtggacctgccag

SEQ ID NO: 11132 - DNA, 301 bp, Homo sapiens
cgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatggg

SEQ ID NO: 11133 - DNA, 225 bp, Homo sapiens
ttgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 11134 - DNA, 351 bp, Homo sapiens
  misc_feature 193, 339, 342, 348: n = A,T,C or G
gagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggnaagaaggtggccgacgcgctgaccaacgccgtggcgcacgtggacgacatgcccaacgcgctgtccgcccttgagcgacctgcacgcgcacaagctttggggtggacccgggtcaactttaagcttcctaagccacttgcctgctnggngacccntgg

SEQ ID NO: 11135 - DNA, 289 bp, Homo sapiens
tcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttc

SEQ ID NO: 11136 - DNA, 270 bp, Homo sapiens
acagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatg

SEQ ID NO: 11137 - DNA, 338 bp, Homo sapiens
ggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcacctgaagagccaccctgtggaaacactacatctgcaat

SEQ ID NO: 11138 - DNA, 334 bp, Homo sapiens
caattagaaatgtgtctaactcactgtcaggattcaagcaactattgaataagtcagaatctgtaaagaaggtgaaatttaccagatgattttggtattcttccctttcagattctaaaaggctctagtgtatttggagaacaaaggggtaatcacaataaatacatctaaaggtatattttatagatcttagaggagatacagaatcttacattaggtagtaggtggtgcaaaatgctatcttcattgatttattacacacacatttattgcaaacattctatgtgtaaaaaatactgtttaatactatgggagataaagaaatgcatgatac

SEQ ID NO: 11139 - DNA, 361 bp, Homo sapiens
  misc_feature 34, 128: n = A,T,C or G
ttcggcacgagaagcattacactcattaggtgancagttcagtaacgtgcacaggaaatgagataaaattcttggatttccaccgctattcacgtgtgacttacgttaacttactgtaaaaatgggcncaccgtactcacaattaaacacacatattacgttttcaccagaacaaaataggtaaaaacctacgataataggattttgccatacgaaggaacataacttcctgtttttatttttgtaaaaggccagtaaaactgatactgattcagagctctataaaaacacttaaaagtgaacactttgaagagtttttgccaaattcctctacaatctcttgcctcatcttatacccaag

SEQ ID NO: 11140 - DNA, 354 bp, Homo sapiens
agtggatccaaagaattcggcacgaggctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggagg

SEQ ID NO: 11141 - DNA, 358 bp, Homo sapiens
ctcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctg

SEQ ID NO: 11142 - DNA, 356 bp, Homo sapiens
gtgatgtccaattttatactttaatccttgcttgttttaaatagtaaaaaatatgtttagtctgtggtaaggtacataagttgtttcttctccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggac

SEQ ID NO: 11143 - DNA, 335 bp, Homo sapiens
ctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggt

SEQ ID NO: 11144 - DNA, 350 bp, Homo sapiens
  misc_feature 262: n = A,T,C or G
ctgaggtaccgggttcatctcactagggagtgccagagagtgggcacaggtcagtgggtgcgcgcaccatgcgtgagccgaagcagggtgaggcattgcctcactcgggaagcgcaaggggtcagggagttccctttcctagtcaaagaaaggggtgacagacggcacctggaaaatcgggtcactcccacccgaatattgcgcttttctgacgggcttaaaaaacggcacaccacgagattatatcccgcacctggctcanagggtcctacgcccacggagtctcgctgattgctagcacagcagtctgagatcaaactgcaaggcaccaccgaggctgggggaggggg

SEQ ID NO: 11145 - DNA, 348 bp, Homo sapiens
ggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagcttgcc

SEQ ID NO: 11146 - DNA, 348 bp, Homo sapiens
gaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaacttttgaagttttggattttacttatttttatccccaaattgttgctattttttaggatctgaaacaaaatctttctaaaacatt

SEQ ID NO: 11147 - DNA, 238 bp, Homo sapiens
gtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaaagagtacttctagagcggccgcgggcccatcgattttccacccgggtggggtaccaggtaagtgtacccaattcgccctatagt

SEQ ID NO: 11148 - DNA, 327 bp, Homo sapiens
  misc_feature 269, 298, 310, 325: n = A,T,C or G
ttcggcacgagggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccantctctgatgaagactggtatctgttctgnggggacacgggnggaaatccttaaaangc

SEQ ID NO: 11149 - DNA, 321 bp, Homo sapiens
  misc_feature 4, 18: n = A,T,C or G
cggnaatagaggccccanatgtctgggtgcaaaagaactccatagcaccccgaccaacatggtgaaaccccgtctctactaaaaatataaaaattaggccgagcacagtggctcatgcctgtaatcctagcactttgggaggccgaggcaggtggattgcctgagctcaggagttcgagaccagcctagggaacacagtgaaaccccgtttctactaaaaatacaaaaaattatgccgacgtggtggcatgcgcctgcagtcccagctacttgggaggctaagacaggagaatcgcttgaacctgggaggtggaggttgca

SEQ ID NO: 11150 - DNA, 352 bp, Homo sapiens
gatccaaagaattcggcacgagccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggcctggactggtgcaatgccggctggctcagtgatggctctgtgcaatatc

SEQ ID NO: 11151 - DNA, 362 bp, Homo sapiens
caggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagt

SEQ ID NO: 11152 - DNA, 319 bp, Homo sapiens
ttcggcacgagtggactcctacctttcaccatatacaaaaattaactcaagatcaattaaagatttaaatgtaaggcctcaaactaagaatcctaaaagaaagcatgggaaacatcattctggacattggccttgggacgtaattgatgactaagttctccaaagcaattacaacaaaaacaaaaattgaaaaagggtacctaattaaactaaagagcttctgcacagcaaaagacactatcaacagattaatcagacagcctacagaatgggagaaaacatttgcaaactatatatctgacaaaggtctagtactcag

SEQ ID NO: 11153 - DNA, 355 bp, Homo sapiens
gcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagcc

SEQ ID NO: 11154 - DNA, 338 bp, Homo sapiens
taacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagcttgcgggagcgggaaggcccttcctgg

SEQ ID NO: 11155 - DNA, 357 bp, Homo sapiens
  misc_feature 2: n = A,T,C or G
gngtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaac

SEQ ID NO: 11156 - DNA, 358 bp, Homo sapiens
gtcgatgtggggaggaacagagggctgaagggagagggggctgactgttccattctagctttggcacaaagcagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccactcaccccactccaccagtccccggtcgc

SEQ ID NO: 11157 - DNA, 366 bp, Homo sapiens
gtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatactt

SEQ ID NO: 11158 - DNA, 272 bp, Homo sapiens
gtgcggtggctcatgcctgtaatcccaacacttcgggagactgaggtgggcggatcacctgaggtccagagttcaagaccagcctgaccaacatggtgaaaccccatctctactaaaaatacaaaattagccgggtgcagtgccacatgcctgtaatcccagctacttgggaggctgaggcaggagaaccacttgaacccaggaggcagaggttgcagtgagccaagattacaccactgcactccagcctgggcaacaagagtgagactttg

SEQ ID NO: 11159 - DNA, 333 bp, Homo sapiens
atcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctctt

SEQ ID NO: 11160 - DNA, 335 bp, Homo sapiens
caagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaatt

SEQ ID NO: 11161 - DNA, 281 bp, Homo sapiens
cttgataagaggcgcaaaagaaaagaatctcaaagtgaaaggaccagttcgaatgcctaccaagactttgagaatcactacgagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgtt

SEQ ID NO: 11162 - DNA, 169 bp, Homo sapiens
gcaacataaaatttaaaaattagccagacatggtggcatgtgcctgtgggtccagcaacctgggtggctaagacggaaggatcacttgagcccaggagttcaaggctgtagtgagccatgatggcaccactgcagtccagccgggcaacagaatgagtccctgtctctt

SEQ ID NO: 11163 - DNA, 311 bp, Homo sapiens
ccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaat

SEQ ID NO: 11164 - DNA, 345 bp, Homo sapiens
  misc_feature 302: n = A,T,C or G
ggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcanagaaggacactgcgtccccacggcctgcgtggcgctgccgtcc

SEQ ID NO: 11165 - DNA, 327 bp, Homo sapiens
accacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctca

SEQ ID NO: 11166 - DNA, 358 bp, Homo sapiens
gtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgt

SEQ ID NO: 11167 - DNA, 169 bp, Homo sapiens
ccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgttttttttttttaaataatt

SEQ ID NO: 11168 - DNA, 360 bp, Homo sapiens
cgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtg

SEQ ID NO: 11169 - DNA, 338 bp, Homo sapiens
  misc_feature 190, 291: n = A,T,C or G
ctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatattttttttttctgaatgagaaacatgagggaaattgnggagttagcctcctgtggtaaaggaattgaagaaaatataacaccttacaccctttttcatcttgacattaaaagttctggctaactttggaatccattanagaaaaatccttgtcaccagattcattacaattcaaatcgaagagtt

SEQ ID NO: 11170 - DNA, 360 bp, Homo sapiens
cttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgc

SEQ ID NO: 11171 - DNA, 366 bp, Homo sapiens
ctcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaata

SEQ ID NO: 11172 - DNA, 277 bp, Homo sapiens
gccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggcttgggtcagcaacccgaattccagtttagaggcggatttggtcgtggacgtggtcagccacctcagtaaaattggagaggattcttttgcattgaataaacttacagccaaaaaacctt

SEQ ID NO: 11173 - DNA, 366 bp, Homo sapiens
cgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccggg

SEQ ID NO: 11174 - DNA, 364 bp, Homo sapiens
  misc_feature 363: n = A,T,C or G
ggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctnt

SEQ ID NO: 11175 - DNA, 358 bp, Homo sapiens
gccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgc

SEQ ID NO: 11176 - DNA, 242 bp, Homo sapiens
  misc_feature 239: n = A,T,C or G
atttggtccttcgtttccttaataataaaatgatggtttggaaaaataggctacagtctaaccacagtgctattattaggctttcttgttaaacacaggtctaagcctaagtatgtcaatacaacaaatacttactgtttcatttctagtaatgaaaaaaaaaacaagtctttctggcataaggatgattttcatctggttattttgaaacatttttgtaaaataaatttacatctttnagg

SEQ ID NO: 11177 - DNA, 178 bp, Homo sapiens
ttcggcacgagaaggaagggagggagggagggagggatatcacactgtatcctataaatatgtacaattattatatgtttcttaaaaataataaaagcagccaggtgctatggctgagcccaggagtttgagagcagcctgggcaacatagtgggacccagtctctacaaaaaatacc

SEQ ID NO: 11178 - DNA, 193 bp, Homo sapiens
gcgacgtgctcacccttttggagtcagagcgagaagcccggaggttgcgctgagcttggctgctcgctgggtcttggatgtcgggttcgaccacttggccgatgggaatggtctgtcacaatctgctcctttttttttgtccgccacacgtaactgagatgctcctttaaataaagcgtttgtgtttcaagtt

SEQ ID NO: 11179 - DNA, 363 bp, Homo sapiens
ccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatg

SEQ ID NO: 11180 - DNA, 361 bp, Homo sapiens
gtggatccaaagaattcggcacgagctctgttcattcttatatatttcctactccaaatccaaaccttatctttttagaagcaatgaccgcatatttttccatcgcctttaattttttcatgagacattatccattgacacttgaagcgagtcatcctgactgacagaaacccagttcctttaagagatgccgagggcagtgtacagaacattctacacaactaaattccagagcctggcagagggtctgagacttgctggggtggcaactaacagctaagtactggatcatgacatgctgcagtgggagaaggagttttctcagctctctgcagctgtttagagagaaaatcaagaaggt

SEQ ID NO: 11181 - DNA, 209 bp, Homo sapiens
ggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccag

SEQ ID NO: 11182 - DNA, 364 bp, Homo sapiens
  misc_feature 288, 348: n = A,T,C or G
agctcccgactccagccctgagagacgaaccaccacagccaaagctgtgtcacctctctgagcctcagtttccccatctctataatggggttctagctgatgtaaagtcctccagtaagatgaaagcagttcttcatcgcaggaggggctggtagaccagtgggaggcccttcaccaaggcccccgacactcagcttgcacctgtgcatgtccagccagagcctgcagtcgcgctcgtgcactcaagcgtgtgcttgcaggaggacgggtatgcgcgcagaggtgtanacagattctgacgcccttgaccttcagtttccacagcataggactcatgatcccaagggnctccctgttagtcgac

SEQ ID NO: 11183 - DNA, 349 bp, Homo sapiens
ccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagc

SEQ ID NO: 11184 - DNA, 372 bp, Homo sapiens
taaagactggaagctcgcgcgcctgcaggtcgacactagtggatccaaagcgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 11185 - DNA, 335 bp, Homo sapiens
gatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatg

SEQ ID NO: 11186 - DNA, 335 bp, Homo sapiens
gtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaat

SEQ ID NO: 11187 - DNA, 338 bp, Homo sapiens
  misc_feature 334: n = A,T,C or G
gcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagcttgccaacaagaagcattagaacaaaccatgctgggntaat

SEQ ID NO: 11188 - DNA, 336 bp, Homo sapiens
ctgactcttgacaccccatctcctttacatgtgctcccagataaactactgcacaaaagtcattgctttatgctttgttctctgttatatgtactggccatattcaaaaataattttggatctttcagtatctatctataatagagtggtacaaatgataattaaataggactagttttagggagacagattacatgctttgttggaaatactgtggcaaagactggcaagccactcaccaaattcacttttcttcctccaaggtatcgagctaaactatatttcccagcctccccacagataagtagaaacagaagtacatgtggaatgcactta

SEQ ID NO: 11189 - DNA, 338 bp, Homo sapiens
gttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtaga

SEQ ID NO: 11190 - DNA, 163 bp, Homo sapiens
ggaccgtgggccgaggtgactgcagaccctcccagggaggctgtgcacaagactgtcttgaacatcccaaatgccaccggaaccccagcccttagctcccctcccaggcctctgtgggcccttgtcgggcacagatgggatcacagtaaattattggatggtc

SEQ ID NO: 11191 - DNA, 192 bp, Homo sapiens
  misc_feature 192: n = A,T,C or G
tcaacatgtcacagaaaacgaacgaaggacaacaagaagtggatgagaatattttgttgaccttcatgggtttacagcctctgtctctaaacaaagtatggaaacaagtagagcttttattttgcttttgtttttggtttggtttttttttttggtttccccccccctaaataaaaaaaggggggccctaan

SEQ ID NO: 11192 - DNA, 332 bp, Homo sapiens
  misc_feature 229, 270, 317, 325: n = A,T,C or G
accagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagctttggcttgctcgctgggtcttnggatgtcggggttcgaccactttggccgatggaaatgggcntgtcacaatctgctcttttttttttgtccgccacaccgtaacttganatgctccntttaaat

SEQ ID NO: 11193 - DNA, 243 bp, Homo sapiens
  misc_feature 37, 87, 176: n = A,T,C or G
tggaaaagcttttgcattttaaagatttttagagccntgcaaaactgggcattaaatgttgcataaagcaaatcttttaagtaaggnaaaatgttgaagtcttaaccagaattcctacaactaattactaaaactgctatttctaactcttcatgaaagcattacctttggaaagntaaactttttttttcctttcatcaccggctttgaaacaaattattttccaattcataagaactttgg

SEQ ID NO: 11194 - DNA, 336 bp, Homo sapiens
  misc_feature 153, 315: n = A,T,C or G
ctcgtgccgcttttctctaattattacgccaactcaagtagttaaaaatcagtaagaaaaatgtcttgagctagaagaacccatagaggaagattttgtaatgcgaatctcctctcataattttagttctgtaaattcagggtttttttttgnttttttggtttttttaagccgaaaaaatgcttaatatgttccagtaagggtattaagtaaaaattaaataaacgtattaagtttaacatattaaattaatttaacatttagactaacattaacatttaaattaataagggaatatacttaatatattctagnacaggtatgccttggaaatag

SEQ ID NO: 11195 - DNA, 327 bp, Homo sapiens
  misc_feature 286: n = A,T,C or G
atttgaaagactcacatctgcctctcaccctggaggatgcatacatgttagattctcccactgagctcagtttcttccttttcttattactttggcagccacaaaagccgatggatttgcactgtatttccttggagagtgcaataatgtaagtatctaaatttagattttggtgctctagataagaaaatatcataagctcctttaaaaaagttataaacaaccgacatttcatgattaagtacttttcatttaaatcattttgtgttttggttctatatttggntattaccagtcaagaattttactgacatggcaacatttagg

SEQ ID NO: 11196 - DNA, 333 bp, Homo sapiens
tggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtg

SEQ ID NO: 11197 - DNA, 333 bp, Homo sapiens
  misc_feature 322: n = A,T,C or G
tacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgncttgtacgttt

SEQ ID NO: 11198 - DNA, 333 bp, Homo sapiens
atctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatcccagctctccctctgatgttgtgtgaccttaaggagtgtaaatggcaccttagtttcagggtcacttgggtatgagcattggatattcccatccctacctcagtaactgaaggacaaaccaagataagtgtgt

SEQ ID NO: 11199 - DNA, 299 bp, Homo sapiens
  misc_feature 14: n = A,T,C or G
agtggatccaaagnaattcggcacgagtaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgt

SEQ ID NO: 11200 - DNA, 334 bp, Homo sapiens
caatgttctaaatcaactttagaatatttatatcacttacaaaccctttaactgtcatcccccaacacccccctcaccctcagctctaagaaactattactgcattttctgtctcgacaggtttgtctattcttaatgttttgaataaatgggctcataccatatttgatcttttgtgactggggtatttcacttggcatatttttgagattcatttatgttgtagcatgtattagtactcatttctttttgttgctaaatgatattctgttgcatgattatgccacattttcttgtcaattggtaaacatttggttttttgactttaagaata

SEQ ID NO: 11201 - DNA, 334 bp, Homo sapiens
atttatgaccaagtagaacccagtggtgtttcctggaggctggcaatgctattccttgatgtggctgctatttacctgagtgttcactttgtgaaaatccacggcccacttatggtttgtccacctttctccatgcatgttgtccttcattcaagtatacattactgatgttttgaaacaattctctctaagctaatatagaatctccattactgaaagtccttagaaatgctgcattggaaaaaattagtccaattattaaaaatctatgaaataaatgctgtgactcagacattaagaggagaatctacaacaagagcagtaggcttgggag

SEQ ID NO: 11202 - DNA, 148 bp, Homo sapiens
gtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaacctt

SEQ ID NO: 11203 - DNA, 279 bp, Homo sapiens
  misc_feature 219: n = A,T,C or G
gtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcgggctggtgcacacccaggagccgggggagnggctgggaactcttgctggagccgggctcccctctacatccttaggggctcagcccggtt

SEQ ID NO: 11204 - DNA, 325 bp, Homo sapiens
ttcggcacgaggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggccttggaagaccacctgccccggcccctctcctg

SEQ ID NO: 11205 - DNA, 327 bp, Homo sapiens
ctgaatttgtccttggaaatattgagtactgtgttaacacagtgtaatgtgcttggttaagcattgagtggagactcagccaatgagacagaatgcatagctgtggtccagtgatccagtgattcacaattagaggcagcctgggaaatgtggtggggcaatcttgattgtgactgggaatggctactggaatttagtgaacactgttctgcaatactggacacatccctgcacaaggaagaactgttccacccaaatgccagtagcacttcttgttctggagattggaaactccttactgatgaaagcctcaggaccttggcagtg

SEQ ID NO: 11206 - DNA, 332 bp, Homo sapiens
ctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctga

SEQ ID NO: 11207 - DNA, 334 bp, Homo sapiens
  misc_feature 160, 196: n = A,T,C or G
aggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgntgggggtttaaaaaattccccccatgtaattattgngaacaccttgctttgtggtcactgtaacatttggggggtgggacagggaggaaaagtaacaatagtccacatgtccctggcatctgttcagagcagtgtgcaagaatgtaatgctcttttgtaagaaacgttttatga

SEQ ID NO: 11208 - DNA, 253 bp, Homo sapiens
atctcaaacagcttggtaaaattagaagcagagtagcatcagaaaatgagaataaagcttcgtttttaatagtaaaactgaaaatgattctttatgagatatattttgaagaaatgttttcataatatttcctttagttttgctggaattaggtagtctagctgaataaattattgttctgggagaatttaccaatgttaacattattttttcccgaataagttagtattatagttttaggcgaaatcttttt

SEQ ID NO: 11209 - DNA, 331 bp, Homo sapiens
ggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaagg

SEQ ID NO: 11210 - DNA, 336 bp, Homo sapiens
ggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctg

SEQ ID NO: 11211 - DNA, 338 bp, Homo sapiens
ggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctg

SEQ ID NO: 11212 - DNA, 305 bp, Homo sapiens
caaagatgtttatgggttagaaattactggccgggcgcgatggctcacgcctctcatcccagcactttgagagaccgaagcgggtggattacgaggtcaggagactgagaccatcttggccaacatggtgaaaccccgcctctactaaaatacaaacaaattagccaggtgtggtggtacgtgcctgtaatcccagctacttgggagactgaggcaggggaattgcttgaacccgggaggcggaggttgcagggagctgagattgcgccactgcattccagcctggtgacagagcaagactctct

SEQ ID NO: 11213 - DNA, 337 bp, Homo sapiens
cggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaat

SEQ ID NO: 11214 - DNA, 267 bp, Homo sapiens
atttgaaaatttctggccaggtgtgctggctcacgcctgtaacccagcactttgggaggccgaggtgggtggatcatgaggtgaggagatcgagaccatcctggctaacacggtgaaaccccgtctctacaaaaatacaaaaaattagccgggcgtggtggcgggcaccttgtagaaccagagtacttctagagcggccgcgggcccatcgattttccacccgggtggggtaccagggtaagtgtacccaattcgccctatagtgag

SEQ ID NO: 11215 - DNA, 335 bp, Homo sapiens
gctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggag

SEQ ID NO: 11216 - DNA, 335 bp, Homo sapiens
gtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaag

SEQ ID NO: 11217 - DNA, 330 bp, Homo sapiens
caccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgac

SEQ ID NO: 11218 - DNA, 340 bp, Homo sapiens
ctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggc

SEQ ID NO: 11219 - DNA, 339 bp, Homo sapiens
aagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctg

SEQ ID NO: 11220 - DNA, 172 bp, Homo sapiens
cggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgttaagatggcagagcccggt

SEQ ID NO: 11221 - DNA, 337 bp, Homo sapiens
tttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaata

SEQ ID NO: 11222 - DNA, 358 bp, Homo sapiens
  misc_feature 353: n = A,T,C or G
tggcatcagaggtgattttaagtagcatggtccagcataatcccagctgctctttctcgtgacatctcttatcatcaatatacatattctttgcattcttatgattcattctcacaaccatcagcaacatgagttataatgatctccattttgcaggtgaagaaagtttttttttatttttattttttgagacagggtctgactctgtcacccagtctggagtgcagtggtgcgatcactgcttactgcagcctcaacctcccaggctcaattgatcctcccacctcagcctcctgagaagctgggagtaaaggtatatgccaccatgcctggctaatttttgtattttttgnggaga

SEQ ID NO: 11223 - DNA, 130 bp, Homo sapiens
cagtctagttaaggaagaaacattaagattgtttaatttttaacatatattcaagaattttaatttgtaaagaattgagccacattgaacacaattgaatgagattcagaataaacttataacatcttga

SEQ ID NO: 11224 - DNA, 331 bp, Homo sapiens
cggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacatttgagccccggtatagacagttcccccagctgaccagatcccaggtgttccagagcgagttcttcagcggactcatgtggttctggattctctggcgcttttggcatgactcagaagaggtgctgggtcacttttccgtatcctgatccttcccagtggacagatgaagaattaggtat

SEQ ID NO: 11225 - DNA, 334 bp, Homo sapiens
caaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcag

SEQ ID NO: 11226 - DNA, 321 bp, Homo sapiens
ttcggcacgaggagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggag

SEQ ID NO: 11227 - DNA, 163 bp, Homo sapiens
agctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttg

SEQ ID NO: 11228 - DNA, 252 bp, Homo sapiens
  misc_feature 14: n = A,T,C or G
gcgaattgctctgntgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaat

SEQ ID NO: 11229 - DNA, 337 bp, Homo sapiens
  misc_feature 287: n = A,T,C or G
agggtatctgtatagagtagaaaaactagaaaattagcttagagtcaggatatgatgacttttgaatgcctggctatgtgattttgtctttatctcttaaatcagaatttcacagagcacagtcttcaaaacagtagtttcataagatgtgatagctattcctcggggatgcagtaagggcgtgagtgagattttgaagttcaaatatatttgggaaattctcaatgaaaaaaaaaatttcctataatacaccttcatggcgctatggttgtattaatgtgcattgngaaactccaagaggaagacagagaccagatgaacccccaaacacatttga

SEQ ID NO: 11230 - DNA, 364 bp, Homo sapiens
ctttttcttaatttatgttacacgtgtgcgtgcatgtgtatgcatttatttttgtgaaaacatgagaatgtaaaatcctggaggttttcccaactggagtgataataaatatcttcctgctttttaaaaactttttctttaaattagtttcttgtttattccttgctgatatatctaatatagattttcttctatctcactttatgcaatacaatagtgtttctgaagttagcctttcaacttgtctttgcaaaagaagtgaagacacttcatgtttaaatgaattgaatggtgcatgatcacgtatgactgtgtgtgtttaaatctgcataacagagtttggcattatttaaagaaagttgga

SEQ ID NO: 11231 - DNA, 338 bp, Homo sapiens
  misc_feature 40: n = A,T,C or G
aattttagaccctttaataagtgagtgccataagaaagtnaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattaga

SEQ ID NO: 11232 - DNA, 335 bp, Homo sapiens
ctcgtgccgtttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtt

SEQ ID NO: 11233 - DNA, 325 bp, Homo sapiens
  misc_feature 206, 244, 310: n = A,T,C or G
caaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggngagcagtgtccttatccaccctaatctcatactccctnattgtccagctgaactacctgtcccctgggagtcaggaccctctgcctgctctctttcctctttanaaatggcacctactg

SEQ ID NO: 11234 - DNA, 333 bp, Homo sapiens
gtctgctctttcatttctgactttattaaattgagtatttcttacttttttcttggttaatttagctaaaattatattcattttcttgaagctttcaaagaataaacttttgtttctattgattttatttattacttttctagtttcattaatttctactctaatcattatcattccttctgcttactttaggtttagtacggacttctttttccagtgtcttaaggtattcactaacggtgcttgcagctgcagtgtttaccccattttccatgaaaaattttgctttgcttttattattatttttgcattgctctagtatatcaactttgg

SEQ ID NO: 11235 - DNA, 239 bp, Homo sapiens; identical to SEQ ID NO: 9480

SEQ ID NO: 11236 - DNA, 355 bp, Homo sapiens
  misc_feature 312, 324, 345, 346: n = A,T,C or G
gttctttctttgagtctatgggacataagtgaggctgtatcaggagggtgaaatttgagtcacatttttatttcatttattagagcacattactgtccattataacttatatgttcatttggtcataaaatagagaattaccagggatgcaaattaaaacattatagcttatgctagtttctacatttttttcacctcagaaattcccgtatcagaaatccgttttgccacagcaaaaacacattgttcacacactcaataaaaacatattggaatcctttatatgccaactggtttttttttttcctgctncctgattttttnattttttcatgtgccacctgnngatgctttt

SEQ ID NO: 11237 - DNA, 290 bp, Homo sapiens
gtgaataatggaggcagaaggccacctcttttgggtgagggagctcactgcttcacagtggccttccagggacagtcttccagctttgcagatcacgaggggcgtccaggaagggctgaggccctcgtcctctgtgggcagtgaccctccaagcccccaccctgtgccacagctcacccttttccaagtatggagagccttgtccagccctgtctcaccaagccctctgcggggaacctcccttgcactttgacagatgagtgcacaccccagcttatccaagggctcac

SEQ ID NO: 11238 - DNA, 339 bp, Homo sapiens
  misc_feature 10, 12: n = A,T,C or G
cttgaaggtncnacactagtggatccaaagaattcgttacgagcccccaccatcctacagaccgggcctgcggatgttccctgagactaggggtaccacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacaagaagcttggggccaaccctggctcctctttccccagcttctgtctgtctcactgtcttccctcccctcccccagctgaggtgtgg

SEQ ID NO: 11239 - DNA, 322 bp, Homo sapiens
  misc_feature 96, 164, 167, 217, 254, 297, 321: n = A,T,C or G
ccgcccacgggggcgcccccccagaagatggccagcaatcggaagtgagcaaaactgccgcaagtctgcagcccggcgccaccatcctgcagcctnctcctgaccacggacgtttccatcaggttccatcccgaaaatctctcggttccacgtccccctggggnttntcctgacccagtccccgtgccccgcttccccgaaacaggctactctcctnggcccccttcatcgggctgaggaagcacagcagcatntttaaacatgtacaaaaatcgattggctttaaaacaccctttnaaataccccttccccccaaaattnt

SEQ ID NO: 11240 - DNA, 271 bp, Homo sapiens
  misc_feature 4, 11, 30, 37, 61, 167: n = A,T,C or G
cttncagtgcnacactagtggatccaaagnaattcgntacgagtgtggaccctgcgtttgncgagcgctatgccccggacaaaacgagcacagtgctgacccggcacagccagccagccacgcccacgccgctgcagagccgcacctccattgtgcaggcagctgcnggaggggtgccaaggagggggcagcaaacaacggcaagactcccgtgtgtcaccagtgccacaaggtcattccggggccgctaccttggtggcgcttggcccac

SEQ ID NO: 11241 - DNA, 325 bp, Homo sapiens
tgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattg

SEQ ID NO: 11242 - DNA, 151 bp, Homo sapiens
ggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgtt

SEQ ID NO: 11243 - DNA, 226 bp, Homo sapiens
ttaggcattgagcatcaacagctgctaacatcacaaaaagagatctgtatcacctatgaagtagtttaaaaaaatatcaagcctgagtctgatcaaacttgtagatccaaatactattttataggaaacacagaagatgggggcaatgtttaactataccataaggatgtaactagcaacatgggaggaattacaaatgacccaatttctttaataaattaattgc

SEQ ID NO: 11244 - DNA, 224 bp, Homo sapiens
aagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaat

SEQ ID NO: 11245 - DNA, 338 bp, Homo sapiens
ctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaag

SEQ ID NO: 11246 - DNA, 317 bp, Homo sapiens
  misc_feature 92, 104: n = A,T,C or G
gcgcgcttgcaggtcgacactagtggatccaaagaattcggctcgagctttgaaataagcccatttgagccctggataacaagggataaagnggagcggatgcncatcacagacatgaaattgcctcacctgcctggcttagaagaccttggtattcaggcaacaccactggaactcaaggccattgaggtgctgcggggtcatcgcacttaccgctggctgtctgctgaaattgaggatgtgaagccggccaagaccgtcaacatttagtgcctcctgagcagctcttggttttggcgtcttttgggtcggcccat

SEQ ID NO: 11247 - DNA, 128 bp, Homo sapiens
  misc_feature 21: n = A,T,C or G
gagaaaggatatgtgaacggnacatttattgttggggagagtggattgtttacatcatgtctggacttttgtctagttgggtagacagttctacaccagcagcccccttaataaagaagtctacacag

SEQ ID NO: 11248 - DNA, 347 bp, Homo sapiens
  misc_feature 17, 36, 43: n = A,T,C or G
cgcgcgcctgcaggtcnacactagtggatccaaagnaattcgntacgagacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtg

SEQ ID NO: 11249 - DNA, 232 bp, Homo sapiens
  misc_feature 180: n = A,T,C or G
ttcggcacgaggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtntattttgggattctaatgttttattttcatgcttatccaaagattactattg

SEQ ID NO: 11250 - DNA, 287 bp, Homo sapiens
  misc_feature 225: n = A,T,C or G
ctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcanggactctcagcacattcaagaacacggagattagtttccagcctggggagaagagtttgatg

SEQ ID NO: 11251 - DNA, 256 bp, Homo sapiens
  misc_feature 20, 196, 238: n = A,T,C or G
aacaagtctctgctggcctnggctcatgttgctgttctcagttcccctgggatgtttgcttccagggaggcctgggcactcctgactttggtgacagccctgcttgctctctctctgttacctgtaggtttccccttccacattcactgcctccgggcaggcacttgttgtgttttaggcatttcagtatcccagnggggtactggataagtgcttagttagcacctgcccggggagnaaataatcaggtcctggg

SEQ ID NO: 11252 - DNA, 126 bp, Homo sapiens
ctaagacccaaactgggattagataccccactatgcttagcccctaaacctcaacagttaaatcaacaaaactgctcgccagaacactacgagccacagcttaaaactcaaaggacctggcggtgc

SEQ ID NO: 11253 - DNA, 148 bp, Homo sapiens
gacaatgtccgtcatggccttaacagaaatctcggattctctcctggggacagagaggaaaatatccgccggattgctgaggtggctaagctgtttgctgatgctggtctggtctgcattaccagctttatttctccattcgcaaagg

SEQ ID NO: 11254 - DNA, 321 bp, Homo sapiens
ttttttctgagagattcaaagcctccacgactctgtttcccccgtcccttctgaatttaatttgcactaagtcatttgcactggttggagttgtggagacggccttgagtctcggtgcgagtgtgcgtgagtgtgagccaccttggcaagtgcctgcgcagggcccggccgccctccatctgggccgggtgactgggcgccggcttgtgtgcccgaggcctcaccctgccctcgcctagtctggaagctccgaccgacatcacggagcagccttcaagcattccattacgccccatctcgctctgtgccccctccccacca

SEQ ID NO: 11255 - DNA, 339 bp, Homo sapiens
  misc_feature 17, 42, 161, 322, 337: n = A,T,C or G
cgcgcgcctgcaggtcnacactagtggatccaaagaattcgntacgagcgcagaccagacttcgctcgtactcgtgcgcctcgcttcgcttttcctccgcaaccatgtctgacaaacccgatatggctgagatcgagaaattcgataagtcgaaactgaanctagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgnaagatgcaaagaggntg

SEQ ID NO: 11256 - DNA, 287 bp, Homo sapiens
  misc_feature 3, 16, 101: n = A,T,C or G
ctngtgcaaatatggnagactaccaggctgcggaggagactgcttttgttgttgatgaagtgagcaacattggaaaagaggctatagaaagcgcaattggnggtaacgcttatcaacacagcaaagtgaaccagtggaccacaaaatgtagtagaacaaactttaagccaactcaccaagctgggaaaaccatttaaatacatcgtgacctgtgtaattatgcagaagaatggagctggattacacacagcaagttcctgcttctgggacagctctactgacgggag

SEQ ID NO: 11257 - DNA, 396 bp, Homo sapiens
  misc_feature 41: n = A,T,C or G
gtgaccttgagtgcccactagtggatccaaagaattcggtncgagctgctctgagttatttggaccacatcattatcacaatccacaaatatattattttccattgatatttgttgatatcttcaccaaaaaggaatttgaagggacaaattttatgtcttgtctctgaaggttataatcaaagcacacagatttaatcttgatccatcctctattcctattgagactagattttcaaaattcaatcaagtgaataacaaattgtactaatattctcagattttatgagacatgaccttctccaagtcatctaaataaagatttacaggtcacttggtttatagctccaaagtacagtttttaaatttcagtgctgggcattgtaatgctataaac

SEQ ID NO: 11258 - DNA, 243 bp, Homo sapiens
  misc_feature 238: n = A,T,C or G
attacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaatttttttttcagtatgcaagcttgcaagatgaaaataaaacctgttngcctg

SEQ ID NO: 11259 - DNA, 319 bp, Homo sapiens
  misc_feature 2, 313, 315: n = A,T,C or G
gngcagtgcccctcatttggtagttaatgtccatatgtctcctatctcattatgtgggagctccctgagagcaaggaatatatgtgaatatatttctctagtgcatagctgaatacattatgcagggtttgtctctgcagttgttaaattagacggaaccaaagtacctgtaaagctgagatgtaacaggatgggattgggtactaaataacctaaggtcctgtccctacagtgccagaacttggggaagctgaccactgttcagattggtcacgataactcaggactgttagccaaatggctagtggattgngncatg

SEQ ID NO: 11260 - DNA, 349 bp, Homo sapiens
  misc_feature 2, 42, 67: n = A,T,C or G
gngcgcctgcaggtcccactagtggatccaaagaattcggtncgagccatttccagtggagcagatngtactcgggccatagtccaaatacttattttctttaatttccctgtatattcattatgccttgatgttacttaatagatcagatatatttattacacatttgcctatatattaatacacatgtgcactctgatctatttattatgtttattaattactttctttgttttccaaaattggaatcatgctacaaatattggtttgttttttaaatgtttatccacttactcaattatcatatttaccattttagattagtacctcattatttttaatagtttta

SEQ ID NO: 11261 - DNA, 325 bp, Homo sapiens
caggttcctctcctcaggtgtcaactctgccctcctccaccctcatatagctttttccttatcaacccttttaccttcctgcttatatccccactttggcttagtttaatgtccagcagtacccctggaaccagggaggaggcaggaggtaagtattggtgactacctccaacactaggcagcatgtcccatttaaaaaacaaaacaaaagccaggcgcggttgctcacgcctgtaatcccagcactttgggaggccaaggcgggtggatcacgaggtccggagttcaagaccaacctggccaagatggcgaaaccccgtctcta

SEQ ID NO: 11262 - DNA, 220 bp, Homo sapiens
ctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatg

SEQ ID NO: 11263 - DNA, 400 bp, Homo sapiens
  misc_feature 17, 41, 385: n = A,T,C or G
gcgcgcctgcaggtcgncactagtggatccaaagtgcgggntgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactgggggagcagcaaggagcaaggagaagaaacacatctggtttggagaaaccatcaatggnggcttccatttcagc

SEQ ID NO: 11264 - DNA, 344 bp, Homo sapiens
caagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttg

SEQ ID NO: 11265 - DNA, 268 bp, Homo sapiens
  misc_feature 6, 19, 44: n = A,T,C or G
gtgacnattgaaggtgcgncactagtggatccaaagaattcggntcgaggtcccgaggggacaaggagcctgggttgcccccaccccgctgagggagttcctcttgccccctacccccggggcttgtatatagattataaatatataagggggaaaggggtgggccggggaggggttgtggggcttggggcctcacttcccctcctcccccttcccctggtcccctgtccctggggctgtttgttaaaaaagagtaataaaaggattt

SEQ ID NO: 11266 - DNA, 286 bp, Homo sapiens
  misc_feature 91, 184, 256, 267, 280: n = A,T,C or G
tgccactgaagatcctggtgtcgccatgggccgccgccccgcccgttgttaccggtattgtaagaacaagccgtacccaaagtctcgcttntgccgaggtgtccctgatgccaagattcgcatttttgacctggggcggaaaaaggcaaaagtggatgagtttccgctttgtggccacattggngtcagatgaatatgagcagctgtcctctgaagccctggaggctgcccgaatttgtgccaataagtacatggnaaaaaagttgnggcaaagatggcnttccat

SEQ ID NO: 11267 - DNA, 237 bp, Homo sapiens
  misc_feature 144: n = A,T,C or G
ggcaggagagcctgcaggagcgcaagcaagcactatatgaatacgcaagaaggagattcacagagagacgagcccaggaggctgactgagctcaaaggaacaggatggcacccagagccgcaggacggagactgggggcagccntcacccaactcacaacaggctggatggatgggtggtaaaaaagggaaggatgaggctcccccaatgtcacattaaattcatggttttcatttc

SEQ ID NO: 11268 - DNA, 340 bp, Homo sapiens
  misc_feature 74, 277, 332: n = A,T,C or G
ctttcttctctagacaacctgaaagcctcagtcagccaagtggaggcggacttgaaaatgctcaggactgctgnggacagtttggttgcatactcggtcaaaatagaaaccaacgagaacaatctggaatcagccaagggtttacctagatgacctgaggaatgatctggataggttgtttgtgaaagtggagaagattcacgaaaaggtctaaatgaattgcgtgtgcagggcgcggatttaaagtccaatttctcatgaccaaaaaatgtgtggnttttttcccatgtgtcccctaccccccaatttcttgtcccctcttaaagagcagntgtcacca

SEQ ID NO: 11269 - DNA, 328 bp, Homo sapiens
  misc_feature 327: n = A,T,C or G
ttgagtccttatgggagagggatgaggggaagaagccccttgtttaatctcattttttctcttcattaaaatgccttcttgcatccttggtctcttttcacagaaccctgccatcagcatcactgaaaacgtgctgcatttcaaaggtcagtatcccagcaaatgctcccatctctatacacagttaaggaggtgtggtggtggtttccctttttttaaaaaaatgtatttgtcttacttgttttttgctgatgttcacgcctctgatcctcatgaggtaagctaaattgttttgaaatatatgattagaaaagtcaaagaattggnt

SEQ ID NO: 11270 - DNA, 400 bp, Homo sapiens
  misc_feature 2, 15, 40: n = A,T,C or G
gncgcctgaggtcgncactagtggatccaaagaattcggncgagtcgacggtctttacaatttggcatgtttttgcagtggctggtaccagttgttcctttccatgtttagtgcttccttcaggagctcttgtaaggcaggcctggtggtgacaaaatctctcagcatttgcttgtcttgtaaaggattttatttctcctttacttatgaaccttagtttggctggatatgaaattctgggttgaaaattctttcctttaagaacattgtatattggcccgcactctcttctggcttgtagggtttctgctgagagatctggtgttagtctgatgggcttccctttgtgggtaacccaacctttctctctggctgcccttaacattttttccttcatttc

SEQ ID NO: 11271 - DNA, 350 bp, Homo sapiens
  misc_feature 14, 175: n = A,T,C or G
gtagacagcaaagntcacctgcgcgggctggggggcctggcctcctgaccttcgccgccctgccctccgccgctccgcctgagctccccggtttgaagaatggaggagggaagttgaaggagccacctcctctgtctacccacccgtccccttcacgcccttgacactaaggagnggggggcccttggactgccccttcctcccccatcgcccgcccccagaacccctgatgctggttaggaaccgctcaccccaacatgtgtcttaaggcaggacgacttggaaaaaaaggcggcggacagttggccagagggatggagactggtgggggacgcccccgccttccctgt

SEQ ID NO: 11272 - DNA, 367 bp, Homo sapiens
  misc_feature 1, 9, 50, 143, 226: n = A,T,C or G
ntttgtgcnccttgaaggtgccgccactagtggatccaaagaattcggtncgagcaacaccctcctagccttactactaataattattacattttgactaccacaactcaacggctacatagaaaaatccaccccttacgagngcggcttcgaccctatatcccccgcccgcgtccctttctccataaaattcttcttagtagctattaccttcttattatttganctagaaattgccctccttttacccctaccatgagccctacaaacaactaacctgccactaatagttatgtcatccctcttattaatcatcatcctagccctaagtctggcctatgagtgactacaaaaaaggattagactg

SEQ ID NO: 11273 - DNA, 400 bp, Homo sapiens
  misc_feature 19, 24, 38, 56, 64: n = A,T,C or G
tggaaaaaaagcccggagntttgngcgcttgcggtcgncactagtggatccaaagnaattcggntcgaggaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccggtgactcccaggaagtcttccctgaagtctgaccacctttcttcttgcttcagttggggcagactctgatccctt

SEQ ID NO: 11274 - DNA, 279 bp, Homo sapiens
  misc_feature 16, 153, 218: n = A,T,C or G
tgggcgcttgaggtcnacactagtggatccaaagaattcgttacgagagttattaaccagactcagaaagaaaacctcaggaaattctacaagggcaagaagtacaagcccctggacctgcggcctaagaagacacgtgccatgcgccgccgnctcaacaagcacgaggagaacctgaagaccaagaagcagcagcgggaaggagcggctgtacccgntgcggaagtacgcggtcaaggcctgaggggccgcattgtcaataaagcacagctggctgag

SEQ ID NO: 11275 - DNA, 239 bp, Homo sapiens
  misc_feature 18, 82, 103: n = A,T,C or G
agaaaatacagcctttgnacccaatgacggttgcttgaactttattgaggaaaatgatgaagttctggttgctggatttggncgcaaaggtcatgctgttggngatattcctggagtccgctttaaggttgtcaaagtagccaatgtttctcttttggccctatacaaaggcaagaaggaaagaccaagatcataaatattaatggtgaaaacactgtagtaataaattttcatatgcc

SEQ ID NO: 11276 - DNA, 400 bp, Homo sapiens
gcgcgcctgcaggtcgccactagtggatccaaagaattcggttcgaggagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttt

SEQ ID NO: 11277 - DNA, 369 bp, Homo sapiens
gcgcgcctgcaggtcgccactagtggatccaaagaattcggttcgagcgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaac

SEQ ID NO: 11278 - DNA, 335 bp, Homo sapiens
ctttctagaaccaacacctgattgctagaagaagtaaagaccttctacaacaatggggaaaaaaatcctgaaagttaatcattgcttcatataatcatgggccttggcataggcccaccagaacctaactagtatccaggactgtttcctttagatggctgttgctaatgagcgagagggaaaaaaatataccttccaatatcaggtgaatgataaacaattgtgtcagactcctcattcctttgccattgataaatgttagaggctctaatcttctctttctggatatgatttcttgaggcttgaatagtatcatggactggggattagaatgg

SEQ ID NO: 11279 - DNA, 399 bp, Homo sapiens
  misc_feature 16, 41, 43, 198, 368, 375: n = A,T,C or G
gcgcgcctgcaggtcnacactagtggatccaaagaattcgntncgagcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgggggngaaaggntctaagacgtgggatcgttttcca

SEQ ID NO: 11280 - DNA, 400 bp, Homo sapiens
  misc_feature 26, 28, 69: n = A,T,C or G
atttttggaacaaaaagccggagttngngcgcctgcaggtcgccactagtggatccaaagaattcggtncgaggttaatttgtacatctccacctcactctggcccaccaagcataagacaatggtcctcaaagccagactttttaaagaaactactgatgggagttatttaatgatagcatctatggtaaacattgttcaggagctatcatggcctcttctgtaccttagaggattcaactgtacatttgatttgtcccactacactaagctttctgagggcatcactgcctctcattccattactgaatccccagttcctgcctggcttagtgcctggatattcagagtttcagtaaatgagttcctttgagaattccaaattttgtttttgagacta

SEQ ID NO: 11281 - DNA, 399 bp, Homo sapiens
  misc_feature 2, 40, 42: n = A,T,C or G
gngcgcctgcaggtccacactagtggatccaaagaattcntnacgagcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgccccagccactttcagccgaggctccaagagtgtggccccgcccgggtccctccaagcccttggagggggcttga

SEQ ID NO: 11282 - DNA, 399 bp, Homo sapiens
  misc_feature 2, 37, 38: n = A,T,C or G
cntgaagtgccacactagtggatccaaagaattcgtnncgaggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccct

SEQ ID NO: 11283 - DNA, 400 bp, Homo sapiens
  misc_feature 42: n = A,T,C or G
tgcgcgcctgcaggtccccactagtggatccaaagaattcgnttcgaggcaaaggaatagaatggaatcgaaaggaaagaaatggcatgaaatggaatagaacggaatggaatcaaatggaatagaatctaatggaatcgaaaggaatggaatcaaatggaatggaatagattccaatggaatggactggaaaagtatgcaatggaatggaatgcaaaggaatggatttgaatggaaaggaaaggaactaaatgcaatggaatcgaatggaatcgaatggaattgaatggaatggaattgaatggaatgaaatggaattgaatggaaacgaagggaaacaaagggaatgaaacagcatggaatggaatccgaagccaaaggaataccatggaatggaata

SEQ ID NO: 11284 - DNA, 338 bp, Homo sapiens
gtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgttgcctaaagctctggaactggtattccaaccagctgaccgaactcactgaccagtacaggcatggttatttcaacattaata

SEQ ID NO: 11285 - DNA, 400 bp, Homo sapiens
  misc_feature 6, 40, 42, 43, 223: n = A,T,C or G
tgtgancttgagtgcccactagtggatccaaagaattcgntnncgagctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcagggncatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagt

SEQ ID NO: 11286 - DNA, 235 bp, Homo sapiens
  misc_feature 171: n = A,T,C or G
gccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgngttgcttctattttacctcaaattgtagatatagggtaatcaataaaatccatccatgcctttc

SEQ ID NO: 11287 - DNA, 255 bp, Homo sapiens
  misc_feature 13, 162, 210, 241: n = A,T,C or G
ctcgtgccgcgcnaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagngtttcaacatggaaattttccttagcccttctggggttgccatggctnaatgggggtctttccagaactttgaatgttngcatacttggggat

SEQ ID NO: 11288 - DNA, 238 bp, Homo sapiens
  misc_feature 20: n = A,T,C or G
gccagttcctcgtagagatnggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgc

SEQ ID NO: 11289 - DNA, 308 bp, Homo sapiens
  misc_feature 4, 7, 106: n = A,T,C or G
tggnggngctaacctaggaagaattggtgtgatcaccaacagagagaggcaccctggatcttttgacgtggttcacgtgaaagatgccaatggcaacagctttgcnactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagc

SEQ ID NO: 11290 - DNA, 398 bp, Homo sapiens
  misc_feature 2, 14, 27: n = A,T,C or G
anttttggaaaaanaagccggagtttngcgcgcctgcaggtcgacactagtggatccaaagaattcggtcgagccaaggcacccctctgacatccggcctgcttcttctcacatgacaaaaactagcccctatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgacc

SEQ ID NO: 11291 - DNA, 122 bp, Homo sapiens
  misc_feature 88: n = A,T,C or G
ttcggcacgagggcgtgtatgccacgcgctcctctgccgtgcgcctgcggagcagcgtgcccggggtgcggctcctgcaggactcggnggacttctcgctggccgacgccatcaacaccgag

SEQ ID NO: 11292 - DNA, 400 bp, Homo sapiens
  misc_feature 2, 43, 68, 172: n = A,T,C or G
gngcgcctgcaggtcgccactagtggatccaaagaattcggtncgagggaaatttgagaccagcaagnactatgtgactatcattgatgccccaggacacagagactttatcaaaaacatgattacagggacatctcaggctgactgtgctgtcctgattgttgctgctggngttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaaggaagtcagcacttacattaagaaaattggctacaaccccgacacagtagcatttgtgccaatttctgg

SEQ ID NO: 11293 - DNA, 203 bp, Homo sapiens
  misc_feature 127, 175, 177, 198: n = A,T,C or G
actgatgcttgtctggtaataatcacttctgtgttataatggaaggttttttgtgatgtatgaaacttgtgttttttatatataaatgagtatagttagtgttgtggtaatgccggtttcatctggnaaatagtttaagtatgtacacgaggcactacttctgatttattgcagngngaggcctagtttttacttttnttcta

SEQ ID NO: 11294 - DNA, 251 bp, Homo sapiens
  misc_feature 17, 18, 249: n = A,T,C or G
tgcgcgcctgcaggtcnncactagtggatccaaagaattcggtacgagggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaangt

SEQ ID NO: 11295 - DNA, 398 bp, Homo sapiens
  misc_feature 26, 68: n = A,T,C or G
cttttggaaaaaaaacccggattttngcgcgcctgcaggtccacactagtggatccaaagaattcgtncgagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgcccggaagcagcttgagggaccagtactgctttgaatgtgactgtttccgtt

SEQ ID NO: 11296 - DNA, 326 bp, Homo sapiens
  misc_feature 284, 290, 294: n = A,T,C or G
caagggcttgtaaattacctaagtacacaccaaaaaatttttaaaagaatcccagtgtcaaataaaagcctgtgagggccccttctagggacttgagtttcaggcctaggatgcaaagcctggcgcagcagccaggggtgactccaggctcctgccggctccaggattctgggaaggggcagactttgggccccctggagcccctctaggcccagtgtccaccccacagaccctgcagtctggggccactcttctgggagaggtgttgtgggccggcttttganccgacnctgncagggcaagagtctctctcctaacatgaaggc

SEQ ID NO: 11297 - DNA, 197 bp, Homo sapiens
  misc_feature 25, 31, 41, 47, 50, 67, 92, 127, 155: n = A,T,C or G
cattctcagacccgattgtctctanggccanggtgccaaanatcccntanagcccccagggaatgcnagggcaggacatacctacggccagnattagctttctcaaagtccccagacagctcccctnggatgctggcttcaatcggcttccctgnggccttgagatactcatcgaacactgcgtcagacagagagac

SEQ ID NO: 11298 - DNA, 400 bp, Homo sapiens
  misc_feature 3, 15, 41, 43: n = A,T,C or G
tgngcgcctgcaggncccactagtggatccaaagaattcgntncgagacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagag

SEQ ID NO: 11299 - DNA, 138 bp, Homo sapiens
  misc_feature 102, 138: n = A,T,C or G
atttttataatcaaaagcttaatatattcccatcttttttagttaaccctttcttgactctgagtgctgtgaatttctttactgatttctctattctccggngagaaacaattaaatgtgatttaacgtaagcggtgn

SEQ ID NO: 11300 - DNA, 352 bp, Homo sapiens
attttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatg

SEQ ID NO: 11301 - DNA, 315 bp, Homo sapiens
gctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttt

SEQ ID NO: 11302 - DNA, 290 bp, Homo sapiens
ttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 11303 - DNA, 393 bp, Homo sapiens
  misc_feature 37: n = A,T,C or G
ggaaaaaaagccggagttttgcgcgcctgcaggtcgncactagtggatccaaagaattcggtacgaggcgccgccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccatt

SEQ ID NO: 11304 - DNA, 178 bp, Homo sapiens
ctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaa

SEQ ID NO: 11305 - DNA, 396 bp, Homo sapiens
  misc_feature 2: n = A,T,C or G
cntgagtgcccactagtggatccaaagaattcgttacgagaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgagaaggcaatt

SEQ ID NO: 11306 - DNA, 351 bp, Homo sapiens
tgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggag

SEQ ID NO: 11307 - DNA, 151 bp, Homo sapiens
  misc_feature 10, 16, 34, 41, 43: n = A,T,C or G
gcgcgcctgnaggtcncactagtggatccaaagnaattcgntncgagggagaaggcaagagaagccctctgggtgttttctttggtcccgcaggagggtgggtggagcaggtggactggagtttctcttgagggcaataaaagttgtcatg

SEQ ID NO: 11308 - DNA, 352 bp, Homo sapiens
  misc_feature 330, 348: n = A,T,C or G
ctcttgtatataaattttgggatatacatatataagcatagctcattttattgtactttgctttattgtgcttcacagatattccttttttgttttgttttacaaattggaagtttgtagcaaccctgcatcgaacaagtctatcagtaccatttttccaacagcatgctctcacttcatgtgtctgtgtcactttctggcaactcctcttgcaatatttcaactttttcattattattatatctgtaatagtgatctgtgatcagtgatctttgatgctattattataaatgttttcaggtgccgcaaactgtacccaggtcagatggngatcttaataaatgttgngatt

SEQ ID NO: 11309 - DNA, 331 bp, Homo sapiens
  misc_feature 3, 5, 38, 46, 68, 78, 83, 84, 130, 145, 161, 177, 200, 208,220, 273, 321: n = A,T,C or G
ttngngcgcttgcaggtcgccactagtggatccaaagnaattcgtncgagggaagccaagaatctggngagcgaagcnatcgnngcttggcatcttcaacgacctgggctccggaagcaacattgacctntgcgtcatcagcaanaacaagctggattttntccgcccatacacagngcccaacaagaaggggaccaggnttggccgntacaggtgtganaaagggactactgcagtcctcactgagaaaatcactcctctggagattgaggngctggaagaaacagtccaaacaatggacacttcctgaatggcatcagngggtggcttg

SEQ ID NO: 11310 - DNA, 327 bp, Homo sapiens
ctgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccggg

SEQ ID NO: 11311 - DNA, 247 bp, Homo sapiens
cacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgc

SEQ ID NO: 11312 - DNA, 290 bp, Homo sapiens
ctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgc

SEQ ID NO: 11313 - DNA, 224 bp, Homo sapiens
aaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattgtaagattaaactgactttcttg

SEQ ID NO: 11314 - DNA, 400 bp, Homo sapiens
  misc_feature 5, 7: n = A,T,C or G
acatnantggccgctagtggatccaaagaaatttttaaggaaaattttaatggtgggatcttgctatgttgctcaggctaaactcaaaatcttgggctcaagtgatccctctatctcagtcctatgagtagctgagactacaggtgcacaccactgcatctggcctctcgattctgttttaacacaaataatatgccaagatcttcgggctcttaaaattttatttggtaatgctatattttcccaaggttaaaagatgcttcccaatttatggaagatagtaggctccttccctgttaattcaggttacttaagactgggagtcttgtgaatgatcacaatgggatacatggagccccatgttacagttgtcatttcatggactttgaaatgtaataag

SEQ ID NO: 11315 - DNA, 154 bp, Homo sapiens
gaccggagtaatccaggtcggtttctatctacttcaaattcctccctgtacgaaaggacaagagaaataaggcctacttcacaaagcgccttcccccgtaaatgatatcatctcaacttagcattatacccacacccacccaagaacagggttt

SEQ ID NO: 11316 - DNA, 353 bp, Homo sapiens
gtaaaacaagatggaggcttacagcacaaaccatacagacacaggaagcataccagattggccacagcccaagactagccctacaaatcctttttcacaattaaagcttaatagagaatatacacagggattcttatcattccttgcctagtaaaatgtcttctagaaataaaaaaacttgcttaaacttaaatgctgatattgtggagaagaggaaagaaaaaaggttttaaaatgcctgtggaagaacctcttattcttatgcaagtgtttccttcaccagggggagaagtgtaattgctgtgggttggagctgggctcccttgactgtgggaggagattccaggggcaca

SEQ ID NO: 11317 - DNA, 328 bp, Homo sapiens
aaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgta

SEQ ID NO: 11318 - DNA, 398 bp, Homo sapiens
  misc_feature 12, 13, 45, 70, 71: n = A,T,C or G
cttcttgggganngaaaacccggagccttgcgcgcctgcaggtcnccactagtggatccaaagaattcgnntcgagggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatgggg

SEQ ID NO: 11319 - DNA, 189 bp, Homo sapiens
  misc_feature 8, 14, 32, 40, 68: n = A,T,C or G
gcgcttgnggtcgncactagtggatccaaagnaattcggntcgagtacaaaaattagatgggcgtggnggcggacacctgtaatcccagctactcgggaggctgaggcgggagaattgcttgaacccgggaggcggagctttgcggtgagccgagatcgtgccactgccttccagcctgggcgacagag

SEQ ID NO: 11320 - DNA, 370 bp, Homo sapiens
  misc_feature 2, 14, 40: n = A,T,C or G
gngcgcctgcaggncccactagtggatccaaagattcggntcgaggtcacctgttaagagtcttagatatcactgatgtgtcttgttaagaaaccttataacaaacgtatttcttaaacttacatctggagctctgcaaagcattagctgttctgcaggaatgacagagggtctcctgtgcggccagctcctctggagtcagggagccatggagccacctgctggttctgaggatggtgacagcaggaggtggagatggcttcatgatctgctgtgagcaacggtgcaaccttctccctgctgttaagtgactagaattcccaggtgcccgcctgctgattagttccagtttgtgttccacgagagcaga

SEQ ID NO: 11321 - DNA, 322 bp, Homo sapiens
  misc_feature 310: n = A,T,C or G
aaaaaaactaaaacacccatctggtctgggcatcttcctttcctttttcactatgtatcctgttactgggcttaaacagctttcagagaagagatgtcatttctattaaatgctctttcagtagcgaactgagttcacacttgactaaggatattttccggactgtctgtcatcagcatccttagtgggtttccccatatttaaattggtagaggccagggatggtggctcacacctgtaatctcagtactttgggaggccaaggtaggtggattgcttgagctcagaagaccagcctgggcaacctggngaaaccctgtct

SEQ ID NO: 11322 - DNA, 290 bp, Homo sapiens
  misc_feature 219: n = A,T,C or G
ctcgtgccgctcgtgccgaatcgcacgagtggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgngggcaaaagagaaaaagaaggattgatcaggagcattgtgcaatacagtttcattaactccttcccccgct

SEQ ID NO: 11323 - DNA, 281 bp, Homo sapiens
  misc_feature 21: n = A,T,C or G
gttggtgtggtggctggaggnggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtg

SEQ ID NO: 11324 - DNA, 364 bp, Homo sapiens
  misc_feature 235: n = A,T,C or G
aaggtcttgaagggacagcatccgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggntttatctgcagtaatatgtatatcatctattagaatttacttaatgaaaaactgaagagaacaaaatttgtaaccccctagcacttaagtactcctgattcttaacattggctttaatgaccacaagac

SEQ ID NO: 11325 - DNA, 293 bp, Homo sapiens
  misc_feature 172: n = A,T,C or G
ccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgncgccttcacacaggtgaactcggaagacaaaggcgctttggctaagctggtggaagctatcaggaccaattacaatgacagatacgatgagatccgccgtcactggggtggcaatgtcctg

SEQ ID NO: 11326 - DNA, 307 bp, Homo sapiens
  misc_feature 12, 298: n = A,T,C or G
gtcgggtggttncatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgnacgggggac

SEQ ID NO: 11327 - DNA, 351 bp, Homo sapiens
  misc_feature 11, 32, 39, 329, 336: n = A,T,C or G
cgcttgcaggnccccactagtggatccaaagnaattcgnttcgagtttttccatggggtcaaaaggtacctaagtatatgattgcgagtggaaaaataggggacagaaatacaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggngtttggngcatttttatcatac

SEQ ID NO: 11328 - DNA, 370 bp, Homo sapiens
  misc_feature 17, 36, 43, 50, 157, 161, 253, 309: n = A,T,C or G
cgcgcgcctgcaggtcnacactagtggatccaaagnaattcgntacgagnatgaagacccagaagatgcagagcttatggtagttcataaatcttcatgttctattatctttcatctgccaataaagttcattttcaataatgtccaccattgctgngccnagaataaccacaggcaaacatcaaaacaatacgcataagttagacaagattaaatcttgtctgatatctgcacaaacagatatgcaccatgntggaaacatgtgttttcctagtcccatccaggcttcccacaagaaagccatgatgngggtctaaaccatatgttttgagtaaaggagaatagaagaaggggagtgtcccgcaaaatg

SEQ ID NO: 11329 - DNA, 327 bp, Homo sapiens
  misc_feature 12: n = A,T,C or G
tgaacagagggnctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatca

SEQ ID NO: 11330 - DNA, 400 bp, Homo sapiens
  misc_feature 2, 43: n = A,T,C or G
gngcgcctgcaggtcgccactagtggatccaaagaattcggtncgagatttaacagggatgcgttctgagaaatgcattcttaggcaattttgtcatccagcaacatgtgcagtggagacccctccactaaagtgtacttacacaaacctggatggtacagcctactacactcctaggccatatggtataacctagtgctcctaggtgacacacccatacagcatgttactgtactgaatactgtatttttactgtaccttttgtatgtgtaggataggtttagatacacaaatacttgcctttgtgtatacacaaatacttccctctgtgtatctaaacctatctaaacctataaaagatacagtaaaaatcctgtataaaagataaacaatggtacac

SEQ ID NO: 11331 - DNA, 332 bp, Homo sapiens
  misc_feature 309: n = A,T,C or G
ctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccnttagtaaaggacttatcaaactg

SEQ ID NO: 11332 - DNA, 263 bp, Homo sapiens
agacagcttatttttaagttgtatagtcttagttggtttagggtctcaattttaattaataaaatacttggtttttatttgcttgtccttttgaattcctgttttaataattttaaaatgagcacaaagaatgttgaagttcagattaatctcttctgaatgatgtttttttcctctgtgatgagttgtttctgacttttttccttttgtatttgtaatgttgattaagatgtaaaataaaaagtgtgcctgattatttttgc

SEQ ID NO: 11333 - DNA, 398 bp, Homo sapiens
  misc_feature 17, 35, 43: n = A,T,C or G
gcgcgcctgcaggtcgncactagtggatccaaagnaattcggntcgaggccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggaccttcggcagtctgt

SEQ ID NO: 11334 - DNA, 274 bp, Homo sapiens
  misc_feature 11, 218, 221, 231, 261: n = A,T,C or G
ctcgtgccganttcggcacgacccagggaggtaggaaaggtaacagaaaaccagcatatttaatcaaagcaagaagtaatcgctgacagttaaatgtgaccaaaaaaaattaaaagttcacaatttttttaatgtagccatttggggttatctctagtaaggcagatacccacgttgggaaatttttaggatattggggttgcactagaaaactaagnggntcatattttntaatgaggaagattaatgaaagaacattgntatattctgcggg

SEQ ID NO: 11335 - DNA, 122 bp, Homo sapiens
  misc_feature 1, 38, 45: n = A,T,C or G
ncgtttaagtctttaatccatcttgaattgatttttgnataaggngtaaggaagggatccagtttcagctttctacatatgactagccagttttcccagcaccatttattaaatagggaatc

SEQ ID NO: 11336 - DNA, 349 bp, Homo sapiens
gctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttgg

SEQ ID NO: 11337 - DNA, 365 bp, Homo sapiens
  misc_feature 4, 19, 38, 65, 71, 86: n = A,T,C or G
aaanaaaagcccggagttnttgcgcgcctgcaggtcgncactagtggatccaaagaaattcggtncgaggngggatcatgtgcaanatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtg

SEQ ID NO: 11338 - DNA, 332 bp, Homo sapiens
  misc_feature 305: n = A,T,C or G
cacaaatgtacatcagtggatgagtgattaaacaaattgtgtacaccaatactatggagggctgctcagacataaagaaatgatttattgacacttactacaacatggatgaatctcaaaagtgctgttgtattttaggtaaaccatgtgataacttgaattacatttgataaaagatttataagtgtaaaaactagatttatatattttaattttatatgtgcctgtcattacatactatagaaaattgtgtctacagtatgttatatagcatattgtaatatttattactgtatattccttgngacaataaaatagtttgtattttatat

SEQ ID NO: 11339 - DNA, 399 bp, Homo sapiens
  misc_feature 11, 50, 71, 72, 73, 76, 77, 87, 95, 104, 122, 154, 159, 164,226, 229, 352: n = A,T,C or G
aaagcccgganttttgcgcgcctgcaggtcgccactagtggatccaaagnaattcggttcgagggtggcannnatnnccttctcggnatcatggncgccctcanaccccttgtgaagcccangatcgtcataaaagagaaccaagaagttcatncggcnccagncagaccgatatgtcaaaattaagcgtaactggcggaaacccagaggcgttgacaacagggtncgnagaagattcaagggccagatcttgatgcccaacattgggtatgggagcaacaaaaaaacaaagcacatgctgcccagtggcttccggaagttcctggtccacaacgtcaaggagcttggaagngctgctgatgtgcaacaaatcttactgtgccgagatcgctcacaatg

SEQ ID NO: 11340 - DNA, 224 bp, Homo sapiens
  misc_feature 21, 172: n = A,T,C or G
tgtcggccaccttcatcggcnacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtncgagtaccagcagtaccaggacgccacggccgacgaacaaggggagttcgag

SEQ ID NO: 11341 - DNA, 179 bp, Homo sapiens
ttcggcacgaggaaaagaaagtgccagtgcctcctcctaaaaagcctgaagtgccacccacaaaagtcccagaggtgccaaaggccgcttgtcccagaaaagaaggtgcctgaagctattcctcccaaaccggaaagtcctccccctgaagtgcctgaagtgctgccaccgaaggaagt

SEQ ID NO: 11342 - DNA, 203 bp, Homo sapiens
gaataaggttagaaacacagtgaaaaaaaataaaaatcctctgaaagatctgtcttctgaaggacaaacaaagcacactaacctaaaacacagaaagacagcagccagcaagagaaaaacctggcaacctctgtcaaagagtaccagagaccatttgcaaactatgatggaatcagtaataatgacaattttgagtaacagta

SEQ ID NO: 11343 - DNA, 272 bp, Homo sapiens
  misc_feature 29, 86, 152: n = A,T,C or G
ccagcctcgaaatgcagaacgacgccggngagttcgtggacctgtacgtgccgcggaaatgctccgctagcaatcgcatcatcggngccaaggaccacgcatccatccagatgaacgtggccgaggttgacaaggtcacaggcaggtttaanggccagtttaaaacttatgctatctgcggggccattcgtaggatgggtgagtcagatgattccattctccgattggccaaggccgatggcatcgtctcaaagaacttttgactggagaga

SEQ ID NO: 11344 - DNA, 392 bp, Homo sapiens
  misc_feature 14, 17, 36, 42, 43, 106: n = A,T,C or G
cgggcgcttgaggnccnacactagtggatccaaagnaattcnntacgagctcaagcccctctcatttttatctgtctacctccattctgaagagggaggttttggngtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccatt

SEQ ID NO: 11345 - DNA, 225 bp, Homo sapiens
  misc_feature 40, 193: n = A,T,C or G
gcgcgcctgcaggtccacactagtggatccaaagaattcnttacgagggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgcttgaagcacgccaggcncttccggggaaggaaaaatcgctgcttacagg

SEQ ID NO: 11346 - DNA, 321 bp, Homo sapiens
gcgcgcctgcaggtcgccactagtggatccaaagaattcggttcgagagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctga

SEQ ID NO: 11347 - DNA, 400 bp, Homo sapiens
  misc_feature 36, 50: n = A,T,C or G
cgcgcgcctgcaggtcgacactagtggatccaaagnaattctgcacgagnagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttc

SEQ ID NO: 11348 - DNA, 375 bp, Homo sapiens
  misc_feature 19, 20, 108, 274: n = A,T,C or G
taggagggcccgagcaggnnttcggtgtggacatagggccggtctgcttcttgtaaaaacctgaacccagaaacaacacaatccgttgcaaacccaaaggacccaagnactttccaatctcagtcactctaggactctgcactgaatggctgacctgacctgatgtccattcatcccaccctctcacagttcggacttttctcccctctctttctaagagacctgaactgggcagactgcaaaataaaatctcggggttctatttatttattgncttcctgtaagaccttcgggtcaaggcagaggcaggaaactaactggtgtgagtcaaatgccccctgagtgactgcccccagcccaggccagaagacctcc

SEQ ID NO: 11349 - DNA, 400 bp, Homo sapiens
  misc_feature 2, 16, 41, 225: n = A,T,C or G
gngcgcctgcaggtcnccactagtggatccaaagaattcgnttcgagggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgnggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagca

SEQ ID NO: 11350 - DNA, 306 bp, Homo sapiens
  misc_feature 293: n = A,T,C or G
attctttttggaaatgtccgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggntgtacttatgtac

SEQ ID NO: 11351 - DNA, 346 bp, Homo sapiens
gcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagtttta

SEQ ID NO: 11352 - DNA, 399 bp, Homo sapiens
  misc_feature 42: n = A,T,C or G
gcgcgcctgcaggtcccactagtggatccaaagaattcggtncgagcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacattgatctgggtatcaaatat

SEQ ID NO: 11353 - DNA, 395 bp, Homo sapiens
  misc_feature 68: n = A,T,C or G
ccttggggaaaaaaagccggatttttgcgcgcctgcaggtccacactagtggatccaaagaattcgtnacgaggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagac

SEQ ID NO: 11354 - DNA, 212 bp, Homo sapiens
  misc_feature 62, 69, 77, 128: n = A,T,C or G
caagaatggaattttaactttactcctaaatagtagaacaatgagttcaagagaggcgtggntaaaagnatgtgtanaatttggcatgttttttgaactaattctgtcctaggcaaaaagatgaatanatttttgtcattgccctaaaggaacttccagccatttggagagatgggatcaaacaattactctcatgcgggaaaatgtgtcta

SEQ ID NO: 11355 - DNA, 400 bp, Homo sapiens
  misc_feature 2, 40, 42: n = A,T,C or G
gngcgcctgcaggtcccactagtggatccaaagaattcgntncgagtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgc

SEQ ID NO: 11356 - DNA, 394 bp, Homo sapiens
  misc_feature 21, 174, 181, 391: n = A,T,C or G
ccgttcctcaactgaaatccntccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgncagctgngcacgatgccatccttgaggacttggtcttcccaagcgaaattgtgggcaagagaatccgcgtcaaactagatggcagccggctcataaaggttcatttggacaaagcacagcagaacaatgtggaacacaagggtgaaactttttctggtgtctataagaagctcacgggcaaggatgttaattttgaattcccagagtttcaattgtnaac

SEQ ID NO: 11357 - DNA, 334 bp, Homo sapiens
  misc_feature 7, 72, 284: n = A,T,C or G
ttcggcncgagctgacctgacctgatgtccattcatcccaccctctcacagttcggacttttctcccctctntttctaagagacctgaactgggcagactgcaaaataaaatctcggggttctatttatttattgtcttcctgtaagaccttcgggtcaaggcaggaggcaggaaactaactggtgtgagtcaaatgccccctgagtgactgcccccagcccaggccagaagacctcccttcaggtgccggggcgcaggaactgtgtgtgtcctacacaatggngctattctgtgtcaaacacctctgtattttttaaaacatcaattgatatt

SEQ ID NO: 11358 - DNA, 216 bp, Homo sapiens
  misc_feature 2, 21, 46: n = A,T,C or G
tnttgcgcgcctgcaggtcgncactagtggatccaaagaattcggntcgaggagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttt

SEQ ID NO: 11359 - DNA, 398 bp, Homo sapiens
  misc_feature 25, 64: n = A,T,C or G
cttcttgggaaagaaaaccccgganccttgcgcgcctgcaggtccccactagtggatccaaagnaattcgtttcgagctcgtgccgctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttaccttgtagattctagtcttcacaggctccctggggctcttaactagtcacactgggagtcatgaatgtctttccaataattcagggaattctagagatcctcaaactgtaaggtctattcatactcaacacaaggaaaaaacctcattaaaattaatgact

SEQ ID NO: 11360 - DNA, 400 bp, Homo sapiens
  misc_feature 4, 11, 29, 47, 74: n = A,T,C or G
cttnttttggnaaaaaaaagcccggattnttgcgcgcctgcaggtcnccactagtggatccaaagaattcggtncgaggaactcctgagctaaagcaatacacttgcctcgtcctccccatgtgctgggattgcaggcgtgagccttggtgctggcccagtgtaccacatttctttttgagatttgttttggctatgttaagtcctttgcttttgatgtgaaatttgggaacaggcagggtgtggtggcttgtgcctgtaatcctagaactttgggaggcctagatgggtggatcacttgagctcaggagttccagaccagcccgggcctatggcgaaactccgtctctacaaaaaaatagaaaaaattagccaggtgtggtggtgcatgcctgtagtca

SEQ ID NO: 11361 - DNA, 329 bp, Homo sapiens
  misc_feature 207, 249, 319, 328: n = A,T,C or G
tgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcanctggaggagttggaggaggaattttgccgcctgaaacccctnctgtctcagctttggggggaactctgtcccccagcctggctgcactttgaggttcccgcccaggaaggcnttttgcaana

SEQ ID NO: 11362 - DNA, 400 bp, Homo sapiens
  misc_feature 21, 22, 65: n = A,T,C or G
tgggaaaaaaagcccggtatnnttgggcgcctgcaggtccccactagtggatccaaagaattcgnttcgaggtctgaagaagtcaagctcgctggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaag

SEQ ID NO: 11363 - DNA, 306 bp, Homo sapiens
  misc_feature 129, 156: n = A,T,C or G
gtggagaatggcagtggagtgtgtgtgtgcccaccagtggagactgtgggctgggcacacgggagggcactcggactggagctgagtgcaagcaaaccatgaagacccagagatgtaagatcccctgcnactggaagaagcaatttggcgcggagngcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaac

SEQ ID NO: 11364 - DNA, 400 bp, Homo sapiens
  misc_feature 6, 9, 87, 166, 169, 201, 334: n = A,T,C or G
caaggntgngggccaggtcatccctgagctgaacgggaagctcactggcatggccttccgtgtccccactgccaacgtgtcagtggnggacctgacctgccgtctagaaaaacctgccaaatatgatgacatcaagaaggtggtgaagcaggcgtcggagggcccnctnaagggcatcctgggctacactgagcaccaggnggtctcctctgacttcaacagcgacacccactcctccacctttgacgctggggctggcattgccctcaacgaccactttgtcaagctcatttcctggtatgacaacgaatttggctacagcaacagggtgggnggacctcatggcccacatggcctccaaggagtaagacccctggaccaccagccccagcaagagcac

SEQ ID NO: 11365 - DNA, 395 bp, Homo sapiens
  misc_feature 22: n = A,T,C or G
gatttgggaggggccagggacngaatgatatgatttgtttttgcctccacccaaatcttatctttaattgtggtttccataatccccacatgtcatgggagggaccaggtggaggtaatttaatcatgggtgtgtttttccccatgctattctcatgataggaagctttcacaagatctgatggttttgtaaggggctttccccttcgcttggctctcattcttctctttcctgtcatcatgtgaagaaggatgtgttttcttcccattctgccataactgtaagttttctgaggcctccctagccatgtggaattattagtcaattaaacctttttactttataaattgcccagtctcaggcagtcctatatagcaatatgagaacagactaat

SEQ ID NO: 11366 - DNA, 394 bp, Homo sapiens
  misc_feature 43, 67: n = A,T,C or G
gcgcgcctgcaggtccccactagtggatccaaagaattcgttncgaggtggcccctggcctggcganggcttcattacttggacaattactctagccttctctttggccattccagtcctccatgttggctaaatgggatctgaccatttctgcactatagcaccttccatggctccccaccgcctccaggaaaaagtcattcagtccagtccttcaataagtagttattgaggtcgggtgcagtggctcatgcctataatcccagcacttcaggaggctcagctgagtggatcacttgaggtcaggagttcaaaaccagcctggccaatgtggtgacaccccgtctctactaaaaatacaaaaattagctgggcgtggcgggctcatgcctgt

SEQ ID NO: 11367 - DNA, 400 bp, Homo sapiens
  misc_feature 2, 14, 31, 43, 46, 69, 70, 72, 174: n = A,T,C or G
cntcttttggaacnataacccggatttttgngcgcctgcaggnccncactagtggatccaaagaattcnntncgaggggccccagaggaaccctgcggagggacttcaatcacatcaatgtagaactcagccttcttggaaagaaaaaaaagaggctccgggttgacaaatggnggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagt

SEQ ID NO: 11368 - DNA, 397 bp, Homo sapiens
  misc_feature 18, 25, 29: n = A,T,C or G
cttttgggaaaaaaagcncggagtnttgngcgcctgcaggtcgccactagtggatccaaagaattcggttcgagcttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagtgtaacaattttgatctgttaaattggattttacatgtacatttgaatgccagaatttctaaataaatcccctggttagg

SEQ ID NO: 11369 - DNA, 400 bp, Homo sapiens
  misc_feature 2, 17, 41, 43, 83, 149, 218, 221, 224, 265, 352, 399: n = A,T,C or G
gngcgcctgcaggtccncactagtggatccaaagaattcgntncgaggccaaggtgggcaggttatgaggtcaggagattganaccatcctggctaacatggtgaaacctcgtctctacgaaaaatacaaaaacttagctaggcgtggnggcatgcacttgtagtcccagctactcgggaggctgaggcaggagaatcacttgaatccgggaggcggnggntgnagtgagccaccgagatcatgccactgcactctagcctcggngacagagcaagactccatctcaaaaaaaaaggcaggccggtgctgtggctcatgcctgtaatcccagcactttgggaggccaaggcnggcagatcacgaggtcaggagtttgagaccagcctgaccaatacggng

SEQ ID NO: 11370 - DNA, 279 bp, Homo sapiens
  misc_feature 2, 17, 41, 44, 237: n = A,T,C or G
gngcgcctgcaggtcgncactagtggatccaaagaattcgnttngaggtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggncccaggcagccctggacaaggctaatgctttccaggggacag

SEQ ID NO: 11371 - DNA, 387 bp, Homo sapiens
  misc_feature 13: n = A,T,C or G
ggaatatcggccnatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaaga

SEQ ID NO: 11372 - DNA, 400 bp, Homo sapiens
  misc_feature 2, 17, 65, 72, 74: n = A,T,C or G
cntcttttgggaacaanaagcccggatttttgcgcgcctgcaggtcccactagtggatccaaagnaattcgntncgagagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttg

SEQ ID NO: 11373 - DNA, 400 bp, Homo sapiens
  misc_feature 6, 13, 38, 62, 64: n = A,T,C or G
taaaanaaagccnggatttttgcgcgcctgcaggtccncactagtggatccaaagaattcgntncgagggcagatgagttgggacctgtgggaatggagctcaggagagagggcagcagggagggtgaagcaatgggccagtcgcggaggaggtgggggctgcagcggcctggcttgtgggaatgcagagagaaacaggccagctgagcgctctccagcccctggcctggcttgtgcctcctcaacctagatcctgagcaacctggtgatggaggagctgggccctgagctgaaggcagagctcggcccgcggctgaaggggaaaccgcaggagcggcagcggcagtggatccagatctcggacgccgtgtaccacattggtgtacgagcaggccaaggc

SEQ ID NO: 11374 - DNA, 269 bp, Homo sapiens
  misc_feature 2, 16, 41, 43: n = A,T,C or G
gngcgcctgcaggtcnccactagtggatccaaagaattcgntncgagacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttga

SEQ ID NO: 11375 - DNA, 393 bp, Homo sapiens
  misc_feature 21, 175, 319: n = A,T,C or G
cggaattccagattattaaantgaccccctcatttcaacccggcaaaacttctcaccccagtgtcataagattcgatagcgatctcccagaaacttggactggaatgctcctacactgaggggatggggggaagaagaaatgctaaagattatttcagagttacagaaatcctgntgaaattccaatgcatcgtttactcttagcgctggggcttcacagtttttttttaagttggaaatatttacaaaatttcccatagggtgaaatccagagttaatccaaaaccagaatcttttaaaattaagtacattcaaatgngcagatttcttaaacctcatttagttgagctttgataggtaaaacgcacgttttgaacaactctggtaacaaag

SEQ ID NO: 11376 - DNA, 400 bp, Homo sapiens
  misc_feature 7, 17: n = A,T,C or G
tctttgnaaaaaaaccnggattttgcgcgcctgcaggtccacactagtggatccaaagaattcgttacgagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcacttttctccaccccagacttcaggactgagccccagcagactcagcaaaagccaaggcggtga

SEQ ID NO: 11377 - DNA, 395 bp, Homo sapiens
  misc_feature 20, 39, 65: n = A,T,C or G
ggaaaaaaaagcccggagtnttgcgcgcctgcaggtcgncactagtggatccaaagaattcggtncgaggccaaatccaagcattctaaaaacttctgcaaatcattacaaagaagtgggcagagatctaaatggcaaagggatgggacagcatagaattgctcttgtggatgtggtttcaagactttccttctccataggaagccaaagaatgaggcaattctctaggaaatgcatctgcccacaggagcaccctggatggatgaagtcctcccttgctgctaagagactctgtaagggaagtgtgaaggcaggacaagtgaggataaggaaaagttaaccatgcaaaaaccaaggagtgaaagaaaggttgggtatttaccataagcttccgg

SEQ ID NO: 11378 - DNA, 400 bp, Homo sapiens
  misc_feature 10, 12, 56, 57: n = A,T,C or G
aaacccggantnttgcgcgcctgcaggtccccactagtggatccaaagaattcgtnncgagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacagga

SEQ ID NO: 11379 - DNA, 400 bp, Homo sapiens
  misc_feature 17, 42, 87: n = A,T,C or G
cgcgcgcctgcaggtcnacactagtggatccaaagaattcgntacgaggcccgtggcaggtccttatatcaccttcacggatgcggncaatgagaccaccatcatgctcaagtggatgtacatcccagcaagtaacaacaacaccccaatccatggcttttatatctattatcgacccacagacagtgacaatgatagtgactacaagaaggatatgggggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggcccca

SEQ ID NO: 11380 - DNA, 163 bp, Homo sapiens
  misc_feature 88, 100, 103, 149: n = A,T,C or G
cagggttttattttatttatgtttacacactaaagtgtcatttaactagttaagaattgtattcttttttattttaaaggttatttgngtgtatcattgnggnaatgttctgtaattattatggttaaatttcatttaatgtaaaatgnttaaaataaaaatg

SEQ ID NO: 11381 - DNA, 398 bp, Homo sapiens
  misc_feature 2, 24, 49, 51, 198: n = A,T,C or G
angtttttgggcgcctgcaggtcnccactagtggatccaaagaattcgntncgaggaacctgggaggcagagcttgcagtgagccgagatcacaccactgcactccagcttgggtgacagagcaagactccgtctcaaaaaacaaaaaggaaagggatggagaaagatataccatgctaacactaatcaaaataaagngggagtagctatactcattttagatagagcagacttcagatcaagaaaagttatcagggataaagagaagaattacataatggtaaagaggtcaatattctaagaagacataaccatctttaatgtatatgtgcctaacaacaggatgccaaaatacatgaggaaaaactgatagaactgcaaggataaatagatgaatc

SEQ ID NO: 11382 - DNA, 279 bp, Homo sapiens
  misc_feature 8, 17, 42, 44, 119: n = A,T,C or G
tgggcgcntgcaggtcnccactagtggatccaaagaattcgntncgagcgggcctccacgtcaagatctcttttcctgtcttggaggtgaaaagtcatatctgagaaaatgtttgcagngacccctagtctggggtacacaggaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggtta

SEQ ID NO: 11383 - DNA, 323 bp, Homo sapiens
  misc_feature 104, 130, 175, 176, 179, 301, 305, 309: n = A,T,C or G
tttttaaaaaataaataatgagcttttattattctcaacaacagagaagactccagcctgatgtctatgggacctgagtccacactgtggagggcacaagctgngggagggcctggaagacacgcctcanagattctcccagtcctgccaccctgtgggagacacttcaaagganncgnaaactcatgtgaccagcagggaggacaacgatgaagaaactttcctgcctaaaatcagctgctgtccagagctagcacctggaaggagacactccctctcctggggtcacatcttcactgcnaggngggnggggagctcacttg

SEQ ID NO: 11384 - DNA, 347 bp, Homo sapiens
accctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtg

SEQ ID NO: 11385 - DNA, 324 bp, Homo sapiens
  misc_feature 23, 60, 139, 233, 312: n = A,T,C or G
agaaaagcaatcctcctgattgnattgttttaaactttaagaatttatcaaaatgccggnacttaggacctaaatttatctatgtctgtcatacgctaaaatgatattggtctttgaatttggtatacatttattctgntcactatcacaaaatcatctatatttatagagggatagaagtttatatatatataataccatatttttaatttcacaaataaaaaattcaaagntttgtacaaaattatatggattttgtgcctgaaaataatagagcttgagctgtctgaactattttacattttatggggnctcatagccaat

SEQ ID NO: 11386 - DNA, 327 bp, Homo sapiens
tggaaatgtagtcataacatttgcagtttattgccttctctctgtattcttcatcagagagatgacagaggttcatgaggcagagaagtgttacttgttgaactttgggctttatgtatgtatacgcaggtattttactatctttcgcatccaacaactctcactagatcagaagcaacagatgacatttgagtgaattctatacttaaataattcatcatgatgcattatttcttcatctatcttcaagagatattttttaaagaaggatccttcctcttggtgatccactctaacaaaaatatcttgctttattttcagcacgta

SEQ ID NO: 11387 - DNA, 339 bp, Homo sapiens
  misc_feature 20, 108, 170: n = A,T,C or G
gcatgacctatcagtatggngctaatgtgtctgtggaccctcgctctctgtctccaggcagttctctcgaacactttgaatgttgtgtaacagttagccactgctggngtttatgtgaacattcctatcaatccaaattccctctggagtttcatgttatgcctgttgcnggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagac

SEQ ID NO: 11388 - DNA, 310 bp, Homo sapiens
  misc_feature 9, 106, 110, 202: n = A,T,C or G
ttcggcacnagagccctagttttgtttcacacatcaagaatgtgcctgtaaaggtagctttatttagttttctaatatttttggcttgaggtttttttctttttgnttgntatcttaaaagtcaataaactttgtaatttctttcagttacctaaattatttctatcttttcaaaacaaatcacttctcatatataaattgnttcttcattaacatggaatcatctattaataaataacatcatctcttcaggattagttctctcatttattttagacagttgatagaaaaaatgaatgtgacagttaca

SEQ ID NO: 11389 - DNA, 333 bp, Homo sapiens
  misc_feature 177, 275, 329, 332: n = A,T,C or G
atggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagngacacctcacccctacacaccgtccgttcacccccgtctcttccttctgcttttcggttttgggaaaagggatccatctccaggcagcccaccttggnggggcttggtttcctgaaccatgatgtacttttttcatacatgagtctgtccanagng

SEQ ID NO: 11390 - DNA, 263 bp, Homo sapiens
  misc_feature 70, 221, 247: n = A,T,C or G
ggaagggcaagtgtgctgtgatcaaaacctctacacgacagacgtacttccttcctgtgattgggttggnggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggnttggacaagcagatccaggagctggnggaggccattgtcttg

SEQ ID NO: 11391 - DNA, 400 bp, Homo sapiens
  misc_feature 11, 18, 34, 154, 239, 336, 383: n = A,T,C or G
aacaaaaagcnggagttngcgcgcctgcaggtcnacactagtggatccaaagaattcggtacgagtccccccctcaccctcaccatctgaggggctccctgagatcttggtagaggaggcccctcctgcccagaccttcgtttgtttccccggnggcccttgcttcttgctttgcagactgcctgcagccatgattttgtcactgacatctgtgagccaaagactgagcctttttggcnggaataataagcaatactacacaacttgctactttcagaaaacttttttttagcttcaccgatgacaacagaggaagaagggaactgggatttgggnaagttctcctccactgtttgaccaaattctcagtgataaatatgtgngcagatccctagaagag

SEQ ID NO: 11392 - DNA, 349 bp, Homo sapiens
  misc_feature 175: n = A,T,C or G
cgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggntgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccg

SEQ ID NO: 11393 - DNA, 361 bp, Homo sapiens
  misc_feature 17, 42, 44, 45, 220: n = A,T,C or G
cgcgcgcctgcaggtcnacactagtggatccaaagaattcgntnncgaggccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatnctgaaggggatgcccagatcgatcccaactgggtggtcctgaaccagggcatggagattgtacagaccatgaacagtgatcctggcctggcagtggggtacacagcttttaatggagttgacttcgaagggaccttccatg

SEQ ID NO: 11394 - DNA, 393 bp, Homo sapiens
  misc_feature 7, 83, 280: n = A,T,C or G
ggaaacnaaagcctggaatttcgcgcgcctgcaggtccacactagtggatccaaagaattcggtacgagcatgaacacacctntccctggacgaaaaaacctgctaattgccttgtaagaaacatcatcacagactcaaggagttgactaatggattctcggaaaattgccagctcataatctctgtgccttgagaattgggataaacattgaggtcaattgcaaagccctatttgaccaaacccacagcccacagtcagtccaaagctagagccctagngttttctatgccagctcttttcattttttctgaattcacaaaactaaatgactcagtttaatgaaggcattcggactaggggaggttaaagggcagatgcaaagcaggaattc

SEQ ID NO: 11395 - DNA, 389 bp, Homo sapiens
  misc_feature 17, 330: n = A,T,C or G
cgcgcgcctgcaggtcnacactagtggatccaaagaattcgtacgaggcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccatctnaaggtgtttgacggcatcccaccgccctacgacaagaaaaagcggatggggggttcctg

SEQ ID NO: 11396 - DNA, 291 bp, Homo sapiens
  misc_feature 126, 193, 198, 248, 275: n = A,T,C or G
aaattattccatttgcaacttatccccaacaggtggtgaagcagtattttccaatttgaagattcatttgaaggtggctcctgccccctgctaatagcagttcaaactaaattttttgtatcaagnccctgaatggaagtatgacgttgggcccctctgaagtttaattctgagttctcattaaaagaaattngcttncattgttttatttcttaattgctacgctacagaaacaatttgtgttttangccctttcccccagtattgtagagcanggtcttgtgttaaaag

SEQ ID NO: 11397 - DNA, 265 bp, Homo sapiens
  misc_feature 133: n = A,T,C or G
taaatctgttgcttccagagccactgtcctccagaagacatccttcacccctgtaggggatgtttttgaactaaatttcatgaacgtcaaattttccagtggttattatgacttccttgtcgaagttgaaggngacaaccggtatattgcaaataccgtagagctcagagtcaagatctccactgaagttggcatcacaaatgttgatctttccaccgtggataaggatcagagcattgcacccaaaactacccgggtgacatac

SEQ ID NO: 11398 - DNA, 353 bp, Homo sapiens
ggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtat

SEQ ID NO: 11399 - DNA, 339 bp, Homo sapiens
atcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcacttgcgctacgccat

SEQ ID NO: 11400 - DNA, 397 bp, Homo sapiens
  misc_feature 2, 7, 40, 42: n = A,T,C or G
gngcgcntgcaggtcccactagtggatccaaagaattcgntncgagaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 11401 - DNA, 330 bp, Homo sapiens
  misc_feature 21, 214, 314: n = A,T,C or G
ctcgtgccgaattgggcgcgngggcatttctagagaacagattcatttgcttaattttcaaaattatgtctccatattactgtttcatgactgactgactaaatgacacccaaaatggttaagatgtacttgactagtttactttatgcatctctttgcaagaatcagccagccaacaatgtctgggatttttattgtatatgttataggaggngagaaatgtaaaatatgaaaatgaatatgtttattttgtattgaaaaagatggttgaaaagatggttgtaagctattatagtataaacacatttttgctnttaaaaatgctattca

SEQ ID NO: 11402 - DNA, 296 bp, Homo sapiens
  misc_feature 134, 174: n = A,T,C or G
tttattcataaaagacacttggtaatagacttcagtgaactctgtatgaatgcagtagtgtgtgtgcaaaatccgcttcctgagcgtagggtgctgagctggcgctagggctcggttgtgaaatacagcgtagncagcccttgcgctcagtgtagaaacccacgtctgtaaggncggtcttcgtccatctgcttttttctgaaatacactaagagcagccacaaaactgtaacctcaaggaaaccataaagcttggagtgccttaatttttaaccagtttccaataaaacggttta

SEQ ID NO: 11403 - DNA, 309 bp, Homo sapiens
  misc_feature 20, 22, 27, 61, 63, 88: n = A,T,C or G
ggaacaaaaagccggagttngngcgcntgcaggtccccactagtggatccaaagaattcgntncgagcttgaaggaaatgacattgcncttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgg

SEQ ID NO: 11404 - DNA, 234 bp, Homo sapiens
  misc_feature 215, 223: n = A,T,C or G
ggaaaacaggacatcctggcctcccaggacctaagggtgactgtggcaaaccaggtccccctggcagcactggccggcctggcgcagagggtgaacctggtgccatgggaccccagggaagacccggtcccccgggacacgttggccaccagggcctcaaggccagccaggaccagcttgggatctttgagtgggtttgaaaggagaccgagganccccgganaaagggccttg

SEQ ID NO: 11405 - DNA, 240 bp, Homo sapiens
  misc_feature 2, 23, 173, 201, 212: n = A,T,C or G
gntacttcttttatattcttggntctttttaccttatccacccgtatctttattttcagggatttccatatccatcagttgggactgaaaactaatctgcattaaagtagcagttgttacttgatatgacttacttttttttttctcatggatatttgaatgttacaggattngggaaggtaatttttttaaattactganaaaaatcttgnggaggattctgattctcaggtctggaat

SEQ ID NO: 11406 - DNA, 256 bp, Homo sapiens
  misc_feature 222, 237: n = A,T,C or G
ctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcgggccttcccccccgacgtgggcggaaacgtcgactacaaaaaacatctgctacgtcatcacgcacgggnacccccaaggaccanggagtaggggcccccgggg

SEQ ID NO: 11407 - DNA, 342 bp, Homo sapiens
aagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctg

SEQ ID NO: 11408 - DNA, 389 bp, Homo sapiens
  misc_feature 349: n = A,T,C or G
gaactatgaggctgtggcccctgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttaccgtagaatagtatcaaaaatttttcgaaatcgtcaatgctgggaagacaggagaaaagcttaattcttgacattttaaataccagttttccaagtaaggagttgatgtaagagccaccttaaacgatgtcaaatacacattttctttttctgtagactggnagatttaatgtttttcattcattaaaataactcaattttg

SEQ ID NO: 11409 - DNA, 396 bp, Homo sapiens
  misc_feature 1, 5, 253, 347, 362, 381: n = A,T,C or G
nacgncccatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagngagctggtcaatgcaacattgggaaacggcagatgtagggtgagaagttaagtatttaatagtatcaaattgttcaaacattgctcagtataantaactggattttaangggggaccttaaaaatggnataaaatatttttca

SEQ ID NO: 11410 - DNA, 372 bp, Homo sapiens
  misc_feature 55, 173, 176, 241: n = A,T,C or G
cttcgacctcttttacaagccgaaagccatcagcagagaactctatgaatattgnattaaagaaggctatgcagacaaaaacctgattgcaaaatggaaaaagcaaggatatgagaacttgtgctgcctgcggggcattcagacacgggacaccaacttcgggacgaactgcntgngccgcgtgcccaaaagcaagctggaagtgggccgcatcatcgagtgcacacactgtggctgtcgnggctgctctggctgaggctggcgcgctccaccctggactctggacttcgcaggttcctgcctgtcacgccacccccttcctgggagcagcgagcagtgccccaggccccgagttggagcacgggctctatg

SEQ ID NO: 11411 - DNA, 400 bp, Homo sapiens
  misc_feature 35, 50: n = A,T,C or G
gcgcgcctgcaggtcgccactagtggatccaaagnaattcggttcgaggnggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaaatcttactgtgccgagatcgctcacaatgtttcctccaagaaccgca

SEQ ID NO: 11412 - DNA, 400 bp, Homo sapiens
  misc_feature 3, 6, 33, 212, 214, 380: n = A,T,C or G
tgnagngcccactagtggatccaaagaattcgnttcgagatttaagtaagtctggcttcgttccagtgtagcctgccaaatgctagttggaattatcatcccctatttatgaaccacagcaatcttctctctctctcgctctctctctctgtcctagctatatgtcccagtccagtctgtctttcggattttgcaccttcgttttatgcctngngatgatgggatgtttccttccttatttcttgacaaaaagagtcactgttaagtagaatctaaattagaaagcatccctcattaagcataaaacaagaattccatgccattgctctcagggtcccagaggtttcaatttagctattttatactcaccatcatatggngtataaatgctcaatctaag

SEQ ID NO: 11413 - DNA, 254 bp, Homo sapiens
  misc_feature 20, 27, 29, 45, 89, 91, 162, 225, 253: n = A,T,C or G
ctttctggggaaaaaaaccncgatctntnggggcctgaagaaacncactagtggatccaaagaattctttttgagcgacttcccgtccngngggccggggcgggcacgatcgcaaggtagcgcagaagcttctcaatggccagcgccagctgcagccccggnggcgcactcgcctcacctgagcctgggaggaaaattcttccaaggatgatctcccactcaganctgaggaagctttttctactcagcagang

SEQ ID NO: 11414 - DNA, 396 bp, Homo sapiens
  misc_feature 8, 14, 30: n = A,T,C or G
cttttggnaacaanaagcccggaattttgngcgcctgcaggtcgccactagtggatccaaagaattcggttcgagattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggc

SEQ ID NO: 11415 - DNA, 398 bp, Homo sapiens
  misc_feature 7, 47, 74: n = A,T,C or G
attttgngcgcctgcaggaaccccactagtggatccaaagaattcgnttcgagctgaatttcaatgtagccttngctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattt

SEQ ID NO: 11416 - DNA, 173 bp, Homo sapiens
  misc_feature 10, 21, 30, 36, 47, 52, 56, 69, 88, 90, 108, 133: n = A,T,C or G
catacattgnttatctgaaangaaatgggncattgnttatctgaaangaaangggnctgggggtcctgnattttatccagcaatcggntnaattccatttcttctgtnttttgaacactgcagggaataacancggggaagctgaatctttgcatacaaaccatgtttcccag

SEQ ID NO: 11417 - DNA, 400 bp, Homo sapiens
  misc_feature 41, 42, 44, 67, 68: n = A,T,C or G
tgggcgcctgcaggtccccactagtggatccaaagaattcnntncgagcgcaagctggctgaccagnncaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactg

SEQ ID NO: 11418 - DNA, 236 bp, Homo sapiens
  misc_feature 66, 176: n = A,T,C or G
tattcaaacagtggataattagaagttgatatttttaatgactttctaaataatactctaattggncctgaacattttattacaaagatgttttattcattttatggatagcttaatcttttcagccaataaatatcacgatgtcctttttttttagtaggggtcttttaaaaaangagaatcttttatttacaattctggccttggttacagggccctcaagggtctcttttcca

SEQ ID NO: 11419 - DNA, 316 bp, Homo sapiens
catagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttc

SEQ ID NO: 11420 - DNA, 309 bp, Homo sapiens
gatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttg

SEQ ID NO: 11421 - DNA, 334 bp, Homo sapiens
  misc_feature 271: n = A,T,C or G
caggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctganaaaaaagctcgtccattgtccgccatgtacttgtcctgtgaagaagttgagtgctgggctttg

SEQ ID NO: 11422 - DNA, 287 bp, Homo sapiens
gttcacacctgtaatccaagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctgggaggtggaggttgcagtgggccaagatcgcaccactgcactccagcctgggtgacagagcgagactctgtctcaaataaataaattatttcac

SEQ ID NO: 11423 - DNA, 309 bp, Homo sapiens
agcaggggaatggcagagtctaaattcatttgagaaggagtcccctggcagcagtaaatagggcaagtggttaggaatggggagaatcttgctggcactcatgggaaacatggtggcctcagcatgctggctgcggggcaggaagggcagatccggaggaagctttatagaggaactcagctgcactgtgccatgccgaaggctactggctgcagagggctgcaagcactcgaaatgtgactgggtcaaattctgaagcactgacaatgcaaaatacacagagatttccaagaaaggagaacgtaagac

SEQ ID NO: 11424 - DNA, 348 bp, Homo sapiens
  misc_feature 297, 333: n = A,T,C or G
gaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctganagcaaccttcgtaaagcctttgaggaggctgagaanaaatgctcctgccat

SEQ ID NO: 11425 - DNA, 310 bp, Homo sapiens
  misc_feature 231: n = A,T,C or G
gtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagnctgtcagatgataaattgtaaataacaatgattaaagagtcatgctacctgatggatctccctttctgtataaacagtg

SEQ ID NO: 11426 - DNA, 285 bp, Homo sapiens
  misc_feature 193, 210, 220: n = A,T,C or G
gtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcaagggtggngacttcacacgccatantggcactggnggcaaagtccatctatggggagaaatttgaagatgagaacttcatcctaaagcatacgggtcctg

SEQ ID NO: 11427 - DNA, 253 bp, Homo sapiens
  misc_feature 170: n = A,T,C or G
gagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggntggggcgacctcggagcagaacccaacctccgagcagtacatgctaagacttcaccccaggtccaaaaaggcgaactactata

SEQ ID NO: 11428 - DNA, 228 bp, Homo sapiens
  misc_feature 101, 172, 221, 227: n = A,T,C or G
gccactggtagctccccacttccttactcctgctgctctgccattgctgctccccttcttgctgcccaagcactgccctcgggcgtctggcagcctgaggngggtggaggggacagtgttctggatagatctattatgtgaaaggcagcttcacccagttttctggactctnatgcccccatctccgacctgggagacttcaggaatgacaacctacccancctggng

SEQ ID NO: 11429 - DNA, 276 bp, Homo sapiens
taaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcaggggcaaaaggttctgaaagccttttaaactcgaaccagtgggggaaagatggatcttgaagctaatcctgcagagagttttatagaggccagggattg

SEQ ID NO: 11430 - DNA, 155 bp, Homo sapiens
  misc_feature 62, 119: n = A,T,C or G
gcgcgcctgcaggtcccactagtggatccaaagaattcggttcgaggaacattatctggacngtattgaaaaccttccctttgaattacagagaaactttcagctcatgagggacctanaccaaagaacagaggacctgaaggctgaaattgaca

SEQ ID NO: 11431 - DNA, 276 bp, Homo sapiens
  misc_feature 239: n = A,T,C or G
ctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcattgaggacagcaatggttgtatcaactatgaagcgnttgtgaggcatatcctgtcggggtgacgggcccatgg

SEQ ID NO: 11432 - DNA, 223 bp, Homo sapiens
  misc_feature 202: n = A,T,C or G
gagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagcccggcagccgacggcaaaggtgtcgtgggnggtcaattaagcggagatccg

SEQ ID NO: 11433 - DNA, 273 bp, Homo sapiens
  misc_feature 88: n = A,T,C or G
caacctacctaaccctttcttatttgtatttgttttagtattgtgaagttgtgttaaatagtactagctagaaatacaaatttctggntatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatgggctgggaaatgggacttgagaagattg

SEQ ID NO: 11434 - DNA, 203 bp, Homo sapiens
  misc_feature 178, 200: n = A,T,C or G
gaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagnaacaaataaataagatcagagncgg

SEQ ID NO: 11435 - DNA, 346 bp, Homo sapiens
  misc_feature 2, 32, 40, 66, 68: n = A,T,C or G
cncttgaaggtgcccactagtggatccaaagnaattcggntcgagaaacaaaccattgcttatgcngntatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtg

SEQ ID NO: 11436 - DNA, 206 bp, Homo sapiens
  misc_feature 10, 94, 118, 176, 195, 201: n = A,T,C or G
ttcggcacgngccgaaatgggcaagttcatgaaacctgggaaggtggtgcttgtcctggctggacgctacctccggacgcaaagctgtcatcgngaagaacattgatgatggcacctnagatcgcccctacagccatgctttggtggcttggaattgaccgctccccccgcaaagngacagctgccatgggcaanaagaanatcgc

SEQ ID NO: 11437 - DNA, 264 bp, Homo sapiens
caacaatgtcaagacagccgtctgtgacatcccacctcgtggcctcaagatggcagtcaccttcattggcaatagcacagccatccaggagctcttcaagcgcatctcggagcagttcacttgccatgttccgccggaaggccttcctccactggtacacaggcgagggcatggacgagatggagttcaccgaggctgagagcaacatgaacgacctcgtctctgagtatcagcagtaccaggatgccaccgcagaagaggagg

SEQ ID NO: 11438 - DNA, 399 bp, Homo sapiens
  misc_feature 16, 42: n = A,T,C or G
gcgcgcctgcaggtcncactagtggatccaaagaattcggtncgagagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagaggggagctgatatcatgaggataacattggcg

SEQ ID NO: 11439 - DNA, 131 bp, Homo sapiens
ttcggcacgagggagccaggactacattaatgatgctgccaagaaggccaaagacctcggctttaagatgtttgctgtgggtgtgggcaatgccgtggaggatgagctgagggaaatagcctcagagcctg

SEQ ID NO: 11440 - DNA, 328 bp, Homo sapiens
  misc_feature 49, 90: n = A,T,C or G
ctgtccatgtcatctcttagatttcttaaaagacattttaatgtatggntaggttttatatttttattttttaaaaaagaaatagtcagngttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgcccta

SEQ ID NO: 11441 - DNA, 342 bp, Homo sapiens
  misc_feature 9, 158, 162, 165: n = A,T,C or G
ttcggcacnagggtaagaggctgtcgaggttaagcgaaggagatgggggcgtgaggggcgtgcaaaggcctggcatactttccattccatccacaggatgcttcctgtgtaggcgtggctaaaagagggagcctaatctggagtccctttcagattgngtgnggntagactgacagatgggttcctgtcagaggatggattaattggttgatcagaaacaccagataaaacaaaccattgaaagctttcaaactgttgaaaggcagtttaaaaaagttcttttaataaaaaaactgagacgcttgtttttaccctcagcttataaaaccatgttctgttcta

SEQ ID NO: 11442 - DNA, 340 bp, Homo sapiens
  misc_feature 172: n = A,T,C or G
ctttcctgtctttccttttttctgagagattcaaagcctccacgactctgtttcccccgtcccttctgaattttatttgcactaagtcatttgcactggttggagttgtggagacggccttgagtctcagtacgagtgtgcgtgagtgtgagccaccttggcaagtgcctgngcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggctt

SEQ ID NO: 11443 - DNA, 399 bp, Homo sapiens
  misc_feature 17, 42, 225, 352: n = A,T,C or G
gcgcgcctgcaggtcgncactagtggatccaaagaattcggntcgagcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcggaggagngcgccctctactggaggggtgaagaacctcatcgttacaggcctggtactgtggcgctccgtgaaattagacgttatcagaagtccactgaacttctgattcgcaaacttcccttccagcgtctggngcgagaaattgctcaggactttaaaacagatctgcgcttccagagcg

SEQ ID NO: 11444 - DNA, 329 bp, Homo sapiens
  misc_feature 58: n = A,T,C or G
ataagcacttaaactgtatccttataagctcaggctccaagaataacttaaatattgngttacctatttgaactggcaagagagtgaataataattacatgcaaaattggtagagagagattcaatgattactaaatttaatcacatttttctgatgaggacaggctgaggtagcttcagtgagttgcccagtgtcccccaggcgagtctcaggaccagagtccagctctgggtttgtctgactccagagtccatattctctctcctgcattcctcgcctctgcagagctcttctgcaacctccagacatgaagccccccatcctcctg

SEQ ID NO: 11445 - DNA, 326 bp, Homo sapiens
ggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggc

SEQ ID NO: 11446 - DNA, 343 bp, Homo sapiens
cacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggca

SEQ ID NO: 11447 - DNA, 193 bp, Homo sapiens
gatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatctttta

SEQ ID NO: 11448 - DNA, 130 bp, Homo sapiens
  misc_feature 13, 17, 20, 38, 79, 86, 108, 121: n = A,T,C or G
ctcgtgccgaatnggcncgngagtacttctagagcggncgggggcccatcgattttccacccggggggggtaccagggnaagtgtncccaattcgccctatagggagncgtattacaattnctgggcggg

SEQ ID NO: 11449 - DNA, 348 bp, Homo sapiens
  misc_feature 174: n = A,T,C or G
aagaaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctggnggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttctt

SEQ ID NO: 11450 - DNA, 311 bp, Homo sapiens
  misc_feature 16, 41: n = A,T,C or G
gcgcgcctgcaggtcnccactagtggatccaaagaattcgntcgagctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattc

SEQ ID NO: 11451 - DNA, 339 bp, Homo sapiens
  misc_feature 8, 11, 35, 44, 56, 318: n = A,T,C or G
cctgcagngcnacactagtggatccaaagaattcnttacgaggngatttccccagnccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctggggggggcttgctctataaagccccctctcccccggaggnggaccacgggtccttgaggga

SEQ ID NO: 11452 - DNA, 300 bp, Homo sapiens
  misc_feature 17, 43, 60, 61, 219: n = A,T,C or G
gcgcgcctgcaggtccncactagtggatccaaagaattcggtncgagcggcaggagaggnnggggggctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccgganatgatcctctccgcctctcgagataagaccatcatcatgtggaaactgaccagggatgagaccaactatggaattccacag

SEQ ID NO: 11453 - DNA, 234 bp, Homo sapiens
  misc_feature 223: n = A,T,C or G
aggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgtngaaataaaaca

SEQ ID NO: 11454 - DNA, 312 bp, Homo sapiens
  misc_feature 292: n = A,T,C or G
ctgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagngacttattaataaaaacagg

SEQ ID NO: 11455 - DNA, 339 bp, Homo sapiens
  misc_feature 258: n = A,T,C or G
gtcaaattgtgatccccagtgttggaggagaggccttgagggaggtaactgcatcatgggaacaaatttctccctacctgttcacatgacagtgagtgatttctcacaagatctgattgttttaaaatgtgtagcccctcccccttcccactcttccttgtgcttgagccaggtaggatgttctggcttccccttcaccttccatcataattttaagcttcctgtggcatacacaggcaggcttcctgtacagcttgnggaaccatgagtcaattaaaccacttttctttataaattacccagtcccaggtacatcttcataacaatgtgagaatggac

SEQ ID NO: 11456 - DNA, 353 bp, Homo sapiens
  misc_feature 173, 174: n = A,T,C or G
gaaatactcctataaagctctgtatacatttagccactttaaattcagtattagcaagtatttattataactctaacagatgtatgtgaataaatattcctgatgaaagaaaaactttagccagattaaatttaaaggagtttaattgagcaatgaacaattcacgaacaatnnagcccccaaaatcacagcagattcacagagacttcagtgcagccacagggtggaagaaagtttatagacaaaaaaaaaggaaatgatgtacagaaattggaagtgaggtacagaacgactggtttggttacaggttagtgtttgccttattggaacacagtttgaacactcagcagtgt

SEQ ID NO: 11457 - DNA, 299 bp, Homo sapiens
  misc_feature 20, 23, 166, 202: n = A,T,C or G
tagtggatccaaagaattcnttncgagggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctnggacgtacaataccacttccgctgtcacggtaaagnccgccatcagaagactgaaggagttgaaagaccagtagacgctcctctactctttgagacatcactggcctataataaatgggttaatttatgtaac

SEQ ID NO: 11458 - DNA, 357 bp, Homo sapiens
aaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtca

SEQ ID NO: 11459 - DNA, 256 bp, Homo sapiens
cggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcctgcgggaaggagcggctgtacccgctgcggaagtacgcggtcaaggcctgaggggcgcattgtcaataaagcacagctggctg

SEQ ID NO: 11460 - DNA, 320 bp, Homo sapiens
  misc_feature 86: n = A,T,C or G
gcaaggtcaccaagtctgcccagaaagctcagaaggctaaatgaatattatccctaatacctgccaccccactcttaatcagtggnggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccatt

SEQ ID NO: 11461 - DNA, 339 bp, Homo sapiens
gccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcaggggatgggggctaggctttgccatcacctccagtttggcttctgagcagagac

SEQ ID NO: 11462 - DNA, 350 bp, Homo sapiens
  misc_feature 52, 55, 124, 140, 245, 315, 332: n = A,T,C or G
agtgcccagcccgccagcctcgctcttggaggctgctctttatcctgcctgnggntttcagctcagagctggacttctatttataagttacctgtatttatatttatatgcccgctctcatggngaaggctggacaaggngctcctctggcccctccttcttacctcagatgcctgaacagaacaaggcaaacccgtagcagcctctcaggagctgacaggtcctctttcggggctcaggagggngggcacacacccagcggcctgcagagtaagcttattacccacaactgtgcccgctttgtgcttctaaggngcacacctagcctaggngagacactgcagccaggc

SEQ ID NO: 11463 - DNA, 329 bp, Homo sapiens
gaacacctgccttttggactttgggggcttaaaagtgtgtttcagaccagttccttggtttgatgttgacacaaacttgtgaatttagtccagcagaaattatcttcatgatctccatctctgtgatgtagggagattaagtcatttggccaaagtcaacccacacactcactcacatgcacacaaagtgccggcaggagtgagacctgaagctgggcgtctcaactgccaatccgctttactacgacaaggagctggcttgcaaggaaagagagaaaagagtttcttgaaagtccctgggggctgtgcctgagcctgtacaagtttat

SEQ ID NO: 11464 - DNA, 339 bp, Homo sapiens
  misc_feature 21: n = A,T,C or G
tccccttgtaaatttaactgntagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattac

SEQ ID NO: 11465 - DNA, 316 bp, Homo sapiens
  misc_feature 258, 298, 302: n = A,T,C or G
ttcggcacgagctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttanacagtgattcctgcaacttgaccttcaggctgggagaggngganagccatgcctgttc

SEQ ID NO: 11466 - DNA, 265 bp, Homo sapiens
  misc_feature 174: n = A,T,C or G
gcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgnatgtaagttatttatatacaaggaaatctattttatgtcgttgtttaagagaattgtgtgaaatcatgtagttgcaaataaaaaatagttt

SEQ ID NO: 11467 - DNA, 328 bp, Homo sapiens
tgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactgg

SEQ ID NO: 11468 - DNA, 396 bp, Homo sapiens
  misc_feature 2, 6, 28, 44, 63: n = A,T,C or G
antttnggaaaaaaaagcccggagtttngcgcgcctgcaggtcnacactagtggatccaaagnaattcggtacgagctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtggctatatggatgccccccaccctaccacacattcgaagaacccgtatacat

SEQ ID NO: 11469 - DNA, 326 bp, Homo sapiens
aatatgtgtcacttccagcctgagacttttaggacttgagactgctttctccacacttcctccctccatctagcagctgcaagcccaatgtcctggatgcccttggaatccaagtgctgaaggaggcaaaagatctcccagctttaagactgcataactgcctggagcagaatctatccatgcactaccactctccacaccctgcgcaacttagcctgttatttgagttagaagtactttactatactaagatacaaaagatttcagatttttcattaaggcatttgtgccaccatgggtaacatagaatcttgttcctgtatgtc

SEQ ID NO: 11470 - DNA, 307 bp, Homo sapiens
  misc_feature 15, 17, 59: n = A,T,C or G
caaataccaaatagngnataaatttggaagattagattcactgttgcacctgtcatggnggaatttgtcccatgtggctcctgtgggtcaggaatacattgtatcaaaaaatgcagatcctggctaacaaggtgaaaccccgtctctattaaaaatacaaaaaattagccggctgtggtggcgggtgcctgtggtcccagatactcaggaggctgaggcaggagaatggcgtgaacctgggaggtggagcttgcagtgagctgagatcacaccactgcactccaacctgggcaacagagctagtctt

SEQ ID NO: 11471 - DNA, 400 bp, Homo sapiens
  misc_feature 41, 58: n = A,T,C or G
gcgcgcctgcaggtcccactagtggatccaagaattcggtncgaggtcgactgacggnaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactg

SEQ ID NO: 11472 - DNA, 398 bp, Homo sapiens
  misc_feature 41, 221, 222, 224: n = A,T,C or G
gcgcgcctgcaggtcccactagtggatccaaagaattcggntcgagatttgggacaccctcttaccggaatccttaccccaggcacaacaccatatgattagaaagagactgccaaaccctcagcttttccgcggagaaagaattggttcatgcctctagcacattcaggagctcagagtagcttgtcttgccagccacatggggggagaatagagatggnngnttggccttgtagattctacagttcctcctttcccatcagcacagagagatcagatgaaaaatctcagctctcaacttcctcctgggagagaaagagttgatccttgtgtccagcgttctaacttctctggggctgccccagagaactggtatctgttttgtcagccttagacct

SEQ ID NO: 11473 - DNA, 324 bp, Homo sapiens
cgtggagtctggggcgtgcccagtgaaaagatggggactttttaattgtccacagacctctctatacctgctttgcaaaaattacaatggagtaactatttttaaagcttatttttcaattcataaaaaagacatttattttcagtcaaatggatgatgtctccctcttttcccctattctcaatgtttgcttgaatcttttattattttttttaattctcccccatacccacttcctgatactttggttctctttcctgctcaggtcccttcatttgtactttggagtttttctcatgtaaatttgtataacagaaaatattg

SEQ ID NO: 11474 - DNA, 340 bp, Homo sapiens
  misc_feature 321: n = A,T,C or G
atggagaatatttgatttttttgatgaacagtgttgcaataatttatgaaaactatcatgcgtgtgtgtctatatgggtatgtgtgtgtgtattttatatttatgaatcgtttatgcagatcgtttcaagaaaagggagtcttgtaagttaactcctaacttagtttctttggggtcctgtgggaagcattggggaaggattagatattgaagtcaaactcaaaaattttactctttagggagagacaattgcacaaaaataaatgtgatgtatagtaaagtgtaaaaactaccatttgaaaaatgcagatgatcagtggnggataacataaaaaaagag

SEQ ID NO: 11475 - DNA, 397 bp, Homo sapiens
  misc_feature 16, 35, 42, 86: n = A,T,C or G
gcgcgcctgcaggtcnacactagtggatccaaagnaattcgntacgagaccaatggtactgaacctacgagtacaccgactacggnggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaat

SEQ ID NO: 11476 - DNA, 400 bp, Homo sapiens
  misc_feature 12, 15, 57: n = A,T,C or G
aaaaagccgganttngcgcgcctgcaggtcccactagtggatccaaagaattcggtncgagctcagccctaccctcaccacctctggggagcagggtgcagacactcacctggtccccagtctcagattcatattcatcaaacccacaggcatcaaagtaatgagggaagggttccgaccagccatcctccgtgcagttccggctcaccactcccatgtctgcagcaaaaagaaaactcagcgaggcccagaaatgattaagagggccctgaaattcttatgcaaaaattacgtattcagtgggaattcctggaaacccctatgaccaactgggaagcatggggaaaggtttcagaaatcagtgattgctgatcagagggatggagagacaaagagcaag

SEQ ID NO: 11477 - DNA, 313 bp, Homo sapiens
  misc_feature 16: n = A,T,C or G
aggtttttttcttagngaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaattt

SEQ ID NO: 11478 - DNA, 396 bp, Homo sapiens
  misc_feature 18, 60: n = A,T,C or G
gggaaaaaaccggatttngcgcgcctgcaggtcccactagtggatccaaagaattcggtncgagctattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgat

SEQ ID NO: 11479 - DNA, 325 bp, Homo sapiens
ctgagacatcagaacctgaacagtacaggcttctaaaggatgaggacatagagttacatagcactctgagtattgtgaacatttgatgagcagtaatgatctaaacatcaatgcaaagataaatacctttaaaacatgttgctgtgtgtttactcacagtagcttataacggtttactttggttgcaaaggctgttttttatatatacgtgtatgtatgtgtatgtgtgtgtatatatatatattttaattgcatctctcacacacacgtatgtaaagatgtatgtcagtatggggaagatatagactatattcattttgctggt

SEQ ID NO: 11480 - DNA, 111 bp, Homo sapiens
  misc_feature 53, 74, 94, 103: n = A,T,C or G
acttctaggaatactagtatatcgctcacacctcatatcctccctactatgcntagaaggaataatactatcgntggtcattatagctactctnataaccctnaacaccca

SEQ ID NO: 11481 - DNA, 344 bp, Homo sapiens
  misc_feature 14, 20, 117, 174, 251: n = A,T,C or G
gggtgggagggggngtgtcngggtgtgcctattgagagcgtgtaatggcgtttgggagctcgtgtgtgtatgtgtgcgtgtgtgtatgtgtgcatgtgtgtgtgtgtgtgtgtgtgnacaccgtgcgcctgagggtgggcatgagtcttgccagaatgtgagtgtgagagtganaatgcaggggtgagtgtgagagggactgcgtttgatttttataatcaaaagcttaatatattcccatcttttttagntaaccctttcttgactctgagtgctgagaatttctttactgatttctctattctccggtgagaaacaattaaatgtgatttaacgtaagcagt

SEQ ID NO: 11482 - DNA, 209 bp, Homo sapiens
  misc_feature 20, 46, 81, 140, 143, 148, 191, 208: n = A,T,C or G
aaggcatcccaaatatgggnccatccctaaacttatacttgcttgnatcatgggatactttgctggaaaactttcttatgngaaaacttgccaagagaaattcaagaaacttgaaaatttcccccttggagaagctttangtnggggngaagcacgacgatcttcaccacctgggcactattatcaaaagncaaaatatgactcaagng

SEQ ID NO: 11483 - DNA, 359 bp, Homo sapiens
  misc_feature 1, 85, 173, 238: n = A,T,C or G
nacaaaaagccggagtttgcgcgcctgcaggtccccactagtggatccaaagaattcggtcgagtttataagttaactaataaanctattttcttcagacttctgcaatagttctttaaaatcacaacagttagcaagctgacttttgtaatgtgctcaatacaaatacttgngaacttttaatatgttgagtgctttcattttgataactggatctccatttgatattttcatttgnataactcatttgcagtctgaaaattttttttagtgccagtccctgaacatatcattgaaagttaattttctttgcattttaaaatatctggattatgaagaaaaagtgatgaaaataaatt

SEQ ID NO: 11484 - DNA, 324 bp, Homo sapiens
tatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactg

SEQ ID NO: 11485 - DNA, 284 bp, Homo sapiens
  misc_feature 17: n = A,T,C or G
catcgaagaaacctggngtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttt

SEQ ID NO: 11486 - DNA, 352 bp, Homo sapiens
  misc_feature 173, 328: n = A,T,C or G
gccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggngaccagggagaactcggagaagttggagctcaaggacctccaggagcccagggtttgcgaggcatcaccggcatagttggggacaaaggggaaaaaggtgctcggggctttagatggtgaacctgggcctcagggtcttcctggtgcaccttggngatcaaggacagcgaggacctcca

SEQ ID NO: 11487 - DNA, 398 bp, Homo sapiens
  misc_feature 3, 18, 42, 44, 67: n = A,T,C or G
tgngcgcctgcaggtccncactagtggatccaaagaattcgntncgaggttgaattcttctagcagnccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaa

SEQ ID NO: 11488 - DNA, 339 bp, Homo sapiens
gaaacattggaagtgcacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggaggggagaagatcttcactttcctgc

SEQ ID NO: 11489 - DNA, 294 bp, Homo sapiens
ccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 11490 - DNA, 326 bp, Homo sapiens
  misc_feature 86: n = A,T,C or G
cttaattatccccccaaagaccttctgattgaagtcatgtacagttcagtggcctaaattctctgcctttttaacttgctttgcangcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactataccttgtcaaatagcacctatctatgcatt

SEQ ID NO: 11491 - DNA, 183 bp, Homo sapiens
accaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgct

SEQ ID NO: 11492 - DNA, 365 bp, Homo sapiens
tcctgcctcagtttctgcatctacaaagtgaagatggtaacaatactgaattcaaagagagggttagagaggtaatgcacatgaagcactcacagtgtctggcagagaggtatggctaaataaatggcggttatttatttatttatttttttgctctgtcaatttttcctctgaatactacatgttttgacatgagtgaaatagatagatgtagccagagaaatgtataatacttggtatttcatgaagaaatctgttgttttcctgtgtttaaagaaacaactcgaaacaatttgatcttcaaatgttagccagctccatgagtcaaataatatcctctgtgctgagctgcctgaagtattcca

SEQ ID NO: 11493 - DNA, 334 bp, Homo sapiens
  misc_feature 319: n = A,T,C or G
gattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtngatgtttcaataaat

SEQ ID NO: 11494 - DNA, 338 bp, Homo sapiens
tttgtaattgccctgcaggtaaaattgaaatgagattccttgtcgtgttataaatagaatgtattccacagtgatatacataagattgttcgcttagaaaaatatatctaaattcctaaagtttctttaaaatgttggtgataattggaattttatgagcttatatatctcaattttcttggcaggctggagctaagaatcccgttgttcggatatttattatcgataccacttaccctgcgtatgtaggtccccaggaagtgcctgttccagcaatgatagcctcaagtgattattatttcagttggctcacgtgggttacctgatgaacgagtatg

SEQ ID NO: 11495 - DNA, 163 bp, Homo sapiens
  misc_feature 127, 135, 155: n = A,T,C or G
ttcggcacgagcccctactcaaatctcagccccatgttgttctttgttattgtcagaacctggtgagttgttttgaacagaactgttttttccccttcctgtaagacgatgtgactgcacaagagcnctgcaggngtttttcataataaacttgngaactaag

SEQ ID NO: 11496 - DNA, 340 bp, Homo sapiens
caaggcagcacacaatattgggccttaatttgggtcaaatattaaatagaattggggagagtaagtattttactttgtgaacttagggaatagcatttaaggtttttaccactgagaatgatggtagccatgggtttttttctgatcagcttaaggatgctttctagttttctgagagcttttccccttccctccctccctctctcccttcttttcccctcccccttccctttgaatgaattttgaatattgccaaatgcttttcccacatctattgagatgataatatgattttctctttccgttactgtgaagatttacattgatttttgaatgttga

SEQ ID NO: 11497 - DNA, 260 bp, Homo sapiens
ttcggcacgagcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcct

SEQ ID NO: 11498 - DNA, 179 bp, Homo sapiens
  misc_feature 109, 113, 173: n = A,T,C or G
cgccgccgcgccgccatcatggacaccagccgtgtgcagcctatcaagctggccagggtcaccaaggtcctgggcaggaccgggttctcagggacagtgcacgcaggtncgcngtggaattattggacgacacgagccggatccatttatccgaaatgtaaaaggcccccggnccgcag

SEQ ID NO: 11499 - DNA, 268 bp, Homo sapiens
accagacttgccctccaatggatcctcgttaaaggatttaaagtggactcattccaattacagggcctcgaaagagtcctgtattgttatttttcgtcactacctccccgggtcgggagtgggtaatttgcgcgcctgctgccttccttggatgtggtagccgtttctcaggctccctctccggaatcgaaccctgattccccgtcacccgtggtcaccatggtaggcacggcgactaccatcgaaagttgatagggcagacgttcga

SEQ ID NO: 11500 - DNA, 283 bp, Homo sapiens
gatgggtttgctggtaataaggctgcttagaagagctaagacaacttgtgttccacttgtggctagaattacatcaattcagtgtggtaaccttgagtacctcaggctgataagacattcagaagagtagttttatttttctacaaattatgattaataatttttaaagaaagaaaacaactcttggcttaataattgtgctttggcgtacaaagcctttcaaaacacaaacacagaattcagtggattaataaaacggggaccaacaggtcaacaagtggtc

SEQ ID NO: 11501 - DNA, 355 bp, Homo sapiens
tatcaatgtgggcaactggggctcaagcctgttaggaactccggaagacagtgtggatgatgcccctgagtgatcccaatcaagaagcaaagaatctggggtatttatccatcaaatcccacacagcatttgttgagattgctcctggcaggacatcaactgccccgtccttcagcctggctgagcaggccagagggttgcagtggccagaggaaggcaaagagcctacatggccttgcaggtggacatggacttccagtgggctttgagtcaatgggctttgagtcaatgggcttgagaaggatgagggcttgagaaggcataggttgggcaccatagtctctgccacagtggt

SEQ ID NO: 11502 - DNA, 332 bp, Homo sapiens
ctcaactgtgttgattctagattggtaagtgacatgctccaagtatagttgactgcatttctgatcttgctttgtttttatgggaattaaactaagaatagcccttcttaataggtcttttcaaaaatttggtagaagagaagttggtgtgttaatcaacataagattttagaatgcatttctatttcaattttctctcctactaatcctgttactgtggttaataatcaatgtgtaaatagtgaatatctgttctttactctgtaccaggtaagacaaatatatatggactctgcttttgaagtacttagaatttaagtttagcaatcaat

SEQ ID NO: 11503 - DNA, 339 bp, Homo sapiens
agaaactcctgggatttctctcagattttgttgtgaatcaaaacacctcaggagttaagcattcctaatgattagaggtcagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctg

SEQ ID NO: 11504 - DNA, 298 bp, Homo sapiens
gtcagatgggaaattcaggcaaaccgggccaacaggggcctccaggagaggtgggaccccgaggaccccgggggcttcctggcagtagaggagaattaggaccagtgggatccccaggcctaccaggtaaactgggttctctgggtagcccctggcctccctggcttgcctgggccccctggacttcctggaatgaaaggtgacagggggtgtagtcggtgaaccgggtccaaagggtgaacagggtgcctttggtgaaagaaggtgaagcaggagaaaggggggaacttggagatat

SEQ ID NO: 11505 - DNA, 336 bp, Homo sapiens
gccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcatttgttgtaaacaaacaagttaagggcaagattcttgccaagagaattaatgtgcgtattgagcacattaagcactctaagagccgagatag

SEQ ID NO: 11506 - DNA, 134 bp, Homo sapiens
ttcggcacgaggtaatctcagctacttgggaggctgaggcaggaggatcgcctggacccgtgagatggaggttgcagtgagctgagatcacaccactgcactctagcatgggtgacagagcaagactctgtctc

SEQ ID NO: 11507 - DNA, 339 bp, Homo sapiens
acagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacagggtttttgtcgctttacattgctt

SEQ ID NO: 11508 - DNA, 363 bp, Homo sapiens
  misc_feature 14, 17, 33, 51: n = A,T,C or G
aaaaaaaccggagnttncgcgcctgcaggtcgncactagtggatccaaagnaattcggctcgagcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 11509 - DNA, 343 bp, Homo sapiens
cagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttg

SEQ ID NO: 11510 - DNA, 192 bp, Homo sapiens
tactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgaga

SEQ ID NO: 11511 - DNA, 344 bp, Homo sapiens
  misc_feature 207, 237, 265: n = A,T,C or G
tcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctnaggacttcctggacagactttcttctctanacaacctgaaagcctcagtcagccaagnggaggcggacttgaaaatgctcaggactgctgtggacagtttggttgcatactcggtcaaaatagaaaccaccgagaac

SEQ ID NO: 11512 - DNA, 333 bp, Homo sapiens
  misc_feature 308: n = A,T,C or G
ggtgaattcctcaaattattttgaagtccacgactccattgaagtgcttaaccctatagaacgcatagaagtcaggggtgacaatattttctgtgtgacaggaacacctgctcaggcaaaatgaatctaagaggcctctctgactatgtatagacgaggcagccatcagatgaaccattatttccaattactagctgatgggagccacatacgaatccacgtccagaaatgaaaactccaaaaacgttctgtttctaaaacccaaacccactcagtctctcattaaaattgctcatgaaaattgctgngtattagcagcacacagagtcatac

SEQ ID NO: 11513 - DNA, 343 bp, Homo sapiens
  misc_feature 168: n = A,T,C or G
gagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggntcgccatcggtggtgtgaactcattgttaagcacaagttcacgaaagcctacaaaagtgtggagaggttccttcaggaggatcaggaaagaccacagcaagattctttcattcgtctcctcctagcctgggggaccaggctcgaactgaccctggacatcaaaggagggattatg

SEQ ID NO: 11514 - DNA, 336 bp, Homo sapiens
ccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctca

SEQ ID NO: 11515 - DNA, 330 bp, Homo sapiens
  misc_feature 175: n = A,T,C or G
cggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgngcggaaatccattgcccgtgttctcacagttattaaccagactcagaaagaaaacctcaggaaattctacaagggcaagaagtacaagcccctggacctgcggcctaagaagacacgtgccatgcgccgccgggtcaacaagcacgaggaggaac

SEQ ID NO: 11516 - DNA, 333 bp, Homo sapiens
atggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtaggtttagaccttctcttcataatcttgctctgagatggggaacagaacacac

SEQ ID NO: 11517 - DNA, 393 bp, Homo sapiens
  misc_feature 4, 15, 34, 338, 359, 388: n = A,T,C or G
aaanaagaccggagnttgcgcgcctgcaggtcgncactagtggatccaaagaattcggctcgaggccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatntgtactctgctctgcagcctnctgtactcattactacttttagcattctncaggc

SEQ ID NO: 11518 - DNA, 320 bp, Homo sapiens
  misc_feature 293: n = A,T,C or G
ttcggcacgagatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagcttgagcaacgtactggccgccatgaggaaagctgctgccaagaaagactgagcccctcccctgccctctccctgaaataaagaacagcttgacagaagccctggctctcctgctgtccgtgggtgggtgtgggtgtgtcngggggcccgcagtcccctgtctggtgc

SEQ ID NO: 11519 - DNA, 345 bp, Homo sapiens
ggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgctt

SEQ ID NO: 11520 - DNA, 357 bp, Homo sapiens
caaaagtaagccaccatgcctggactgtgccactgccctcagccaatattttgaatttgagaatagaaggacctagaaaaggagactgagaaggaagtaaccagagaagaaaaccaagagagtttggtgtcatgtaattcaagaggaagaagtatttcaagaagaagtacttgcaagcaatggtcaattattttgaatgccattggaaatgagacagaatgaggattagatttgttaagaatagcagacagtaaggcctgtgttcttagaacctgataccaatcttccccctggcctttttcttactgttaaagaaaagcagcctcctgatggtcagtgggaccctccgttagtaag

SEQ ID NO: 11521 - DNA, 100 bp, Homo sapiens
ctggagcgcccactattgactctaaagaattccaattcaaatactccccagactcccgagggagctgaaggatgtggctgatagtgctaacagtgcaaac

SEQ ID NO: 11522 - DNA, 321 bp, Homo sapiens
  misc_feature 153, 209, 259: n = A,T,C or G
gtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagngaatatattacccatgaaataacagtgttgattatttataaccttttgacaatagnggagatgctacacaaagcagaaatagtccatggtgacttgagtccaaggngtctgattctcagaaacagaatccacgatccctatgattgtaacaagaacaatcaagctttg

SEQ ID NO: 11523 - DNA, 334 bp, Homo sapiens
gttaattctggaagcccctcattttaagtgaaatctaagcatggcacgtaagtctcacagtgtccacagctaacccatggagaagaggtcaggtacagggtaagcagaggtttcaccctctgctcacaatgtccacagccaacccatggagaagaggtcaggtacagggtaagcagaggtttcaccctctgctcacaatgtccacagctaacccatggagaagaggtcaggtacagggtaagcagaggtttcaccctctgctcacagtgtccacagctaacccatggagaagaggtcaggtacagggttagcagaaggtttcaccctgaaaatg

SEQ ID NO: 11524 - DNA, 333 bp, Homo sapiens
gtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagg

SEQ ID NO: 11525 - DNA, 306 bp, Homo sapiens
  misc_feature 149, 263, 272: n = A,T,C or G
ttcggcacgagtacagttcttttcattcatacataagttcagtagttgcttccctaactgcaaaggcaatctcatttagttgagtagctcttgaaagcagctttgagttagaagtatgtgtgttacaccctcacattagtgtgctgtgnggggcagttcaacacaaatgtaacaatgtatttttgtgaatgagagttggcatgtcaaatgcatcctctagaaaaataattagtgttatagtcttaagatttgttttctaaagntgatactgngggttattttttgtgaacagcctgatgtttggga

SEQ ID NO: 11526 - DNA, 336 bp, Homo sapiens
acacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgtta

SEQ ID NO: 11527 - DNA, 336 bp, Homo sapiens
ccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaat

SEQ ID NO: 11528 - DNA, 338 bp, Homo sapiens
  misc_feature 287, 316: n = A,T,C or G
gggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagcttggaccgagagatgancaggagcgtggacgtgaccaacaccaccnttcctgctcatggccgcctcca

SEQ ID NO: 11529 - DNA, 358 bp, Homo sapiens
  misc_feature 241: n = A,T,C or G
taaaaacaaaatgtatcttctataaaataatcctaagtaaccaaagcaaatgctataaaatagagaccagctcccaggcaagaaatcaccaaagaacccttcagttcttcccattcctcacctccattcaaccaggttccaagtcaccagatatagtatatattctagctccatattccctaggaatccttccttgcctcagcttttactgtttcctatccttctccctaactccagctgntgctagacacatctagcccccataaaaccctttctaaagaactcccaggcttctaatgctataacgcctatactctgattctaaatgtcatcctgattttcatatactttcttatca

SEQ ID NO: 11530 - DNA, 332 bp, Homo sapiens
  misc_feature 33, 64, 78, 98, 249: n = A,T,C or G
tgtcaacccagttaaaaaaaaaattaatgctgngtaaaatggttgaattagtttgcaaactatntaaagacatatgcngtaaaaagtctgttaatgcncatcctgtgggaatggagtgttctaaccaattgccttttcttgttatctgagctctcctatattatcatactcagataaccaaattaaaagaattagaatatgatttttaatacacttaacattaaactcttctaactttcttctttctgngataattcagaagatagttatggatcttcaatgcctctgagtcattgttataaaaaatcagttatcactataccatgctatag

SEQ ID NO: 11531 - DNA, 267 bp, Homo sapiens
caagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctt

SEQ ID NO: 11532 - DNA, 338 bp, Homo sapiens
tgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggcttgttgttccattgaagccgactctggccctggcccttacttg

SEQ ID NO: 11533 - DNA, 289 bp, Homo sapiens
tggcagctatttatattattttcatgaactactactaggggaactataggtggatttcttataataataatggcagaagaattcattaaagaaaacactgatagatttagtttcataaattctcattaattctagacataaaaaccataaatcaaaatacagggaaattttttaacatatgtcacagaaaaagaagcagtatctttaatatgcaaagagtttttaaaaatcgatagcagatttttgacaagagtaccaagaaaattcagtgaggaaagtatactcctta

SEQ ID NO: 11534 - DNA, 301 bp, Homo sapiens
  misc_feature 138, 243, 268: n = A,T,C or G
agcagatgagagaatgcttcattatctttggaggttgggagatatgagggaccaggaagctttcctggaagagcttacattatgacccaatatacattatgacccaacataacacatgtatacacctatgtgcaatgngtttatacatttatcaatttgtatgttttttactggtttgtgatataaaatggacatgtatatgaaataaaacagaacttagcatcagtatgcatagttctctgnaatattttctagtttcttatactgnggttcattaaacaaaacaaaacttttaaaaatt

SEQ ID NO: 11535 - DNA, 187 bp, Homo sapiens
  misc_feature 100, 118, 124, 145, 163, 165: n = A,T,C or G
agaccgcctgccttgtgaacctgcgcagcctggcctgccagcccatcagcttctcgggcttcggggcagaggacgatgacctgggaggcctggggctggncccttgactcaaaaaagnggtttngaccagagaggcccagatggnggctgttcattccctgcngngtcgggcatttgtaaataaagc

SEQ ID NO: 11536 - DNA, 334 bp, Homo sapiens
  misc_feature 61, 287: n = A,T,C or G
ttgactgccattttgtttgttcagtggagactccctggccaacagaatccttcttgatagnttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcggngtttgtgcttttctccaagtcagcacccaaaggtcaatgcacagaga

SEQ ID NO: 11537 - DNA, 325 bp, Homo sapiens
gtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatg

SEQ ID NO: 11538 - DNA, 325 bp, Homo sapiens
ttcggcacgaggttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtatttggattgccacacggctcacattgcatgcaagtttgctgagctgaaggaaaagattgatcgccgttctggtaaaaagctggaag

SEQ ID NO: 11539 - DNA, 337 bp, Homo sapiens
gcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcac

SEQ ID NO: 11540 - DNA, 366 bp, Homo sapiens
gaaatatccagattagaaatttaagaatgtaaacacctgtttgataggatccccttaggagccttaactacctttatgcagatggtagagggggagcaggaaaatgtggggataggatgttttggctaagcttgaccttggggatgagaacagtcggggagttagaaattcacccattgtccaaatgcaaccaagtgtggagtagacaattctaatttcaagaaagaggaggaagattgtgtccttcacagccaggactgtgttccatcagaaccaatatttattgcgcttgacaaaggaaaagaaagaaaggaagaaagaaacaggagggagaaaaaaagcactgccaccaccatctagttaagg

SEQ ID NO: 11541 - DNA, 294 bp, Homo sapiens
attcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggttttggtggccactgaggtg

SEQ ID NO: 11542 - DNA, 333 bp, Homo sapiens
attcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactatttt

SEQ ID NO: 11543 - DNA, 208 bp, Homo sapiens
tggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctga

SEQ ID NO: 11544 - DNA, 337 bp, Homo sapiens
aaaaattataacttaaaaattgcagttttcaatatgagaatcatttatgtgtgtaaatactcaactaagaaaaatcaaaagtgtggtataatattacaagaaaaaatattcaaaatggaaagtccatttatgaatgtattaatattaaaatccaaagttatgtttttttataatgtctacattataatgtttacaaaggccataaaatcatttcagaaagttctcatcctccagatattgaccaataaaacttcatttcctagaaaaaagaagaaatgttataatttatacaaagatgaagtaagattttggaattacgtatacttacaccttcatt

SEQ ID NO: 11545 - DNA, 102 bp, Homo sapiens
  misc_feature 80, 91: n = A,T,C or G
ttcccccaggatctttcttatatctatcagatctaggtgaaaggattactgtcttgtaggtgtcctgaaggacaagccgnttcgtttgaanctgtgaaatac

SEQ ID NO: 11546 - DNA, 332 bp, Homo sapiens
ccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagca

SEQ ID NO: 11547 - DNA, 330 bp, Homo sapiens
gctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggccttgaagtaccatcctgataagaacccaaatgaaggagagaagtttaaacagatttctcaagcttacgaagttctctctgatgcaaagaaaagggaattatatgacaaaggaggagaacaggcaattaaagagggtg

SEQ ID NO: 11548 - DNA, 225 bp, Homo sapiens
  misc_feature 155: n = A,T,C or G
ccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgnatcgccccgcgccccgcgtcgggtcccatccggcccatcgtgcgctgccccacggttcggtaccacacga

SEQ ID NO: 11549 - DNA, 179 bp, Homo sapiens
gacaggagtgtttgtcatttttcatactgttttcttaataagcgctcaggcctaaggtgtgacaggaagtcgcacgcgcttggccagagcacagtgaagcaaaggactgggtgctgatggatggagccacggcggcatctgcccacccggccgcagcccccagtgcctctcctggtggt

SEQ ID NO: 11550 - DNA, 280 bp, Homo sapiens
taatggtttaagacatccaaatggcaagccaggaatagataccattaaagggtctcataggactaaccttaccagagccagaaatctagctctctggaagagatgcaagattctagaaaagtaaagggaagtgtcggcacatctaaatttagtgaacacaaaattaatttttatctagtctgtgacggagggaataaagtttttcatgtatcaaccacctcccccagtcaggtttctccctttttgagattatgaagaagctgagacatacttcttaagg

SEQ ID NO: 11551 - DNA, 292 bp, Homo sapiens
ccttagtgaaaaatttgggaagtactggtcatttagtggaatttcaaaattccactaatggatgatacaaatgaaaagcatgatacaaatgaaaatgaaaattttttgtgttaaattttttttgatgtgctgttttagttcctctgttgatttttaagctatgtattaaattgtttttgcagtttctggagggattacatcttttatttagtacagtctgtttcagattagtattcatctgactccagtaaaatacagcaactttgctcttatataattccattcttccttc

SEQ ID NO: 11552 - DNA, 224 bp, Homo sapiens
  misc_feature 21: n = A,T,C or G
tctgtctctgggggtcaccancaacgctgggacaagcagcagagggtggggggcaccggcctcggcgtgtggcccctcgggctgtcctgcacgggcctctcagaccggtagcaagctctgctcattcctgagcgacacccaaggctgtcactgttagagggaagccctcagtgcacagccagttcccagaccctcccccgcgctgtgtgcctggcgtccccgga

SEQ ID NO: 11553 - DNA, 303 bp, Homo sapiens
cggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaaga

SEQ ID NO: 11554 - DNA, 300 bp, Homo sapiens
  misc_feature 11: n = A,T,C or G
aatctttttcnctttcatagcccactttaatactaggaagaaatacaatatgtatcttgcactactgcttagtaactgtgctcttgtcatttgagaattaacatttggattaaagagcatgattagaagattctaaattagtagttaccaagctgaaatgacacaaaagttaaaacaaagtaatacaacagtctatttcatgcaatttatttcttataccagttaattagcactttaattagcatgatgtttcatgttgtgacctaagccattgtattcccaacgggtttaggtgaagac

SEQ ID NO: 11555 - DNA, 197 bp, Homo sapiens
cttctttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttctt

SEQ ID NO: 11556 - DNA, 335 bp, Homo sapiens
atacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccacaaaagccaaaaaatgggagacaatttcacatggactttggaaaatatttttttcctttgcattcatctctcaaacttagtttttatctttgaccaaccgaacatgaccaaaaaccaaaagtgcattcaacctta

SEQ ID NO: 11557 - DNA, 251 bp, Homo sapiens
  misc_feature 106: n = A,T,C or G
ctcgtgccggtttgttttgtatcttgtttttctgatcggagcatcactactgacctgttgtaggcagctatcttacagacgcatgaatgtaagagtaggaaggggngggtgtcaagggatcacttgggatctttgacacttgaaaaattacacctggcagctgcgtttaagccttcccccatcgtgtactgcagagttgagctggcaggggaggggctgagagggtgggggctggaacccctccccgggag

SEQ ID NO: 11558 - DNA, 261 bp, Homo sapiens
  misc_feature 149: n = A,T,C or G
ctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggngtattttgacctacgaattggagatgaagatgtaggccgggtgatctttggtctcttcggaaagactgttccaaaaacagtggataattttgtggccttagctacaggagag

SEQ ID NO: 11559 - DNA, 248 bp, Homo sapiens
  misc_feature 160: n = A,T,C or G
tgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagngaactattttgtacaatagaggactgtaactactatttaggttgtacagattgaaatttagttgtttcattggctgtctgaggaggtg

SEQ ID NO: 11560 - DNA, 116 bp, Homo sapiens
acctgtaatcccagctatttgggaggctgaagcaggagaatcacttgaacctggaaggtggaggttgcaagtgagccgagatcgtgctattgcgctccagcctgggcgacaagagc

SEQ ID NO: 11561 - DNA, 325 bp, Homo sapiens
gtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccag

SEQ ID NO: 11562 - DNA, 101 bp, Homo sapiens
cggaaaccaaccaaaccgtgcgctgtgacccattgctgttctctgtatcgtgatctatcctcaacaacaacagaaaaaaggaataaaatatcctttgtttc

SEQ ID NO: 11563 - DNA, 356 bp, Homo sapiens
gagataaatgaggcagaagtcaatgtatacagcccttgcgattgtcattaccggtctctgacacaagagggaagcagaaattaactcaagatgtctccctatttgtaattcaagtcatccgcaaatagtccattatatggtaaagtggacaagcacttaaagaaaatagttaaatgttctcattatggaacagtttattgttattttaatattggaaagaactcccaatacctattttgctgccagagggagtttatggaaaacaatgcacataggatttaagagattagattgaaagtcaaacaaatttggagtcaagttgggctcaggttcatactgactgggtaaccttggac

SEQ ID NO: 11564 - DNA, 207 bp, Homo sapiens
gttgctttgacttatataaagagtatcttaagggtgggcatggtggctcatgcctgtaatcccagaactttatgaggctgaggcagacagatcacctgaggtcagcagtttaaaaccagcctggctaacatgataaaaccctgcctctactaaaaatataaaaatgagccaggcatggtggtgcatgcctttaatcccaactacttg

SEQ ID NO: 11565 - DNA, 231 bp, Homo sapiens
ttcggcacgagaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctt

SEQ ID NO: 11566 - DNA, 236 bp, Homo sapiens
caaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactg

SEQ ID NO: 11567 - DNA, 334 bp, Homo sapiens
cgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctcccgggttgacaaatgggtgggggtaacaggaaagggaactggctaccgttcggactatttgtagtcatgtacagaacatgatcaagggtgttacactgggcttccgttacaagatgaggtctgtgtatgctcacttccccatcaacgttgttatccaggagaat

SEQ ID NO: 11568 - DNA, 282 bp, Homo sapiens
aataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccaagatttagatgtttttaattaaacttttctcttcctttttttttcactaaagcatgtttattcccctaatccattaaagagcatgaaaaaaagaataaatgtatttg

SEQ ID NO: 11569 - DNA, 338 bp, Homo sapiens
tggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttc

SEQ ID NO: 11570 - DNA, 338 bp, Homo sapiens
gttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttctt

SEQ ID NO: 11571 - DNA, 332 bp, Homo sapiens
gtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctcttt

SEQ ID NO: 11572 - DNA, 332 bp, Homo sapiens
gactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcatttggaaggccttcggcctaccatcccaccaggtatttcccctcatgtgtgtaagctcatgaagatctgcatgaatgaagaccctgcaaagcgacccaaatttgacatg

SEQ ID NO: 11573 - DNA, 337 bp, Homo sapiens
gtttttcagaaaatccattattaagagtagaggaatgaggagaaatattcgttctaaagagaatcaaaaccacaatgagagattgtcttacccccgttagaatgacagttaccaaaagacagtaacaaatgctgacgagaatgcagaggcaaaggaacgtttaaacactgttagtgggaatgtagacttgtacaaccgttatggagaagagtattggaggttcctgaacaaactaaaaatagaactaccatatgattcagcagtcccactactgggtatatatccaaaagaaaatccatatatggagacatctgcacctgccatgctcgttccagca

SEQ ID NO: 11574 - DNA, 185 bp, Homo sapiens
ctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaacctt

SEQ ID NO: 11575 - DNA, 336 bp, Homo sapiens
atcagggtgagtttgccttggcctaggcttgaaaatagcatggtgcatctggagcttactataaagtcttaaacctaagatgtttgtcatcatgggttttcaagaaatacaaccatgatcttagtggtctggaaggaagttcctaataacaactagctaaatataacatatgacacttactaaatttagagacactgagattgtgtttattctttacattaatacccttcttttgaaaattaaaattaacccttgtttactgaaagccctcaagtaacttgttacagactttatgtttttataaaatgagcttgtgcaatgttctttatttttttt

SEQ ID NO: 11576 - DNA, 337 bp, Homo sapiens
acaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtat

SEQ ID NO: 11577 - DNA, 339 bp, Homo sapiens
aaaatgtctaattatacaatccttggacaatactgtgtttttttggtgctgtgttttttaagaagtcctacttactggaattttgactatttggatatttttgtttttaaaaggggaggggaatttgcttaatacttctaaagatgtgaattgataattgatattaaaatagaattactctcaactcaccagaattaaattttatatctgcatatttaacactattagctcatataaattataagaaaaattttcaaaggatctggttttaattttttggatatgaaatgaatttgccttttctgccttttcttaagtactattttgtaactatattgc

SEQ ID NO: 11578 - DNA, 236 bp, Homo sapiens
  misc_feature 19, 37: n = A,T,C or G
cgcccgtcgcgccgcccgnccgctcattgtccgctcnacggcatgggagtgcaggtggaaacccctctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttg

SEQ ID NO: 11579 - DNA, 324 bp, Homo sapiens
gtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagttttttttcttcgcaggatttttctgagccttttaccactccagcctagcccctaccccccaactaggagggcactggccccc

SEQ ID NO: 11580 - DNA, 334 bp, Homo sapiens
ccaagacagagggaagaaggggagccaggacagcggggctccgggggaggccatggagagactgggaagagcgcagaggtgtgacgacagtccagcacccagaaaagagcgactggcaaacaaggtttttattaaacccaaaaagaaaaatgtgtctggctgtcttaaggtccaggctgcatgctgaccatgtcacccccacttggccttgtgtcttggggaacgcagtgctttgagcattttcaagagcagtttttcctgaaagtcagatcccagagtgagactagtcatcatcttttctcagataatcaaattatttttcaccaggaaaaag

SEQ ID NO: 11581 - DNA, 317 bp, Homo sapiens
gtgcagtggtatgatctcggctcactgaaacctccgcctcccgggttcaagcaattctcctgcctcaacctcccaagtggctggctctacaggccctctccaccatgcctggctaatttttgtatttttagtaaagaccaggtttcaccatgttggccaggctgatctcaaactcctgacctcgtgatcggcctgccttggcctcccaaagtgctgggattacgggtgtgagccaccgtgtccggcctaagtgttttaattttaatatattttaaaatcaaaggaaaaaagaatatggtaatgaatatgtgtaactg

SEQ ID NO: 11582 - DNA, 323 bp, Homo sapiens
  misc_feature 208: n = A,T,C or G
gcaaaatgcttccaaagccccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagngacctaaagttggtaagatgtcataatggaccagtccatgtgatttcagtatatacaactccaccagacccctccaacccatataacaccccacccctgttcgcttcctgtatgg

SEQ ID NO: 11583 - DNA, 283 bp, Homo sapiens
gagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggattttggtctctttgactaatcaccaaaaagcaaccaacttagccagttttatttgcaaaacaaggaaataaaggcttactttcttt

SEQ ID NO: 11584 - DNA, 332 bp, Homo sapiens
tctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattc

SEQ ID NO: 11585 - DNA, 335 bp, Homo sapiens
  misc_feature 318: n = A,T,C or G
cctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaaggtggacacaacagcagtctccttcagcacggcgtgggngtgtcccctggacacag

SEQ ID NO: 11586 - DNA, 337 bp, Homo sapiens
attgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccataatataatggttggatta

SEQ ID NO: 11587 - DNA, 266 bp, Homo sapiens
gcggatatcatcgcaagactccgggaggacgggatccaaaaacgtgtgatacaggaaggccgaggagagctcccggactttcaagatgggaccaaggtggagagccctggcacgaagagaaggcaaaggcagtgccactttatccaccaggagggcaaccggttgtaccgcgaggggcatgtgaaggaggctgctgccaagtactacgatgccattgcctgcctcaagaacctgcagatgaaggaacagcctgggtcccctgaatg

SEQ ID NO: 11588 - DNA, 323 bp, Homo sapiens
ttcggcacgagatctattctaagagatgctcttagtgatcttgcattacactttctgaataaaatgaagataatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattca

SEQ ID NO: 11589 - DNA, 339 bp, Homo sapiens
gaatctgtatagatggctagtttcgcaaagtaaagcacagagccagtgaactgggggcaaactacacgttttggataatgtgagcctaaaaagaaaaaccctaaaacttttaaataaatttctaaaaaccaaaaccttttagtatatgtaatttactggcttaaaactataaatattatagttttaataattttgtagatcaggaatttaggtgggactcagctggccatttgtttccatgtcatgtatccaaagctcactctgtagtatcacctggtagatgggttgacctgaaaggtccaaggtggcttcccttatgtgtctgccaccttacgggag

SEQ ID NO: 11590 - DNA, 335 bp, Homo sapiens
gcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcatttgt

SEQ ID NO: 11591 - DNA, 326 bp, Homo sapiens
aaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtgg

SEQ ID NO: 11592 - DNA, 339 bp, Homo sapiens
gtttgtacctgttttcagaagaaaacagcaatattggaacaaaacaaatcattttaataaggtgactaatttattagaaaactaacaacctcaaaaatgctgaaagcaaatctatactctctctgctttgtactgaattcattactgtaaaatattatggcttatggttcagaatctccccatgcagatgttctgtttttacttgcctggtactcatggtagagccatacatttcttttttcttacaatttcttttacagtttatgaagtattatatgagctggtcagggattacaacaattattttttttataaaatttaagtagtgcacaaaaagta

SEQ ID NO: 11593 - DNA, 339 bp, Homo sapiens
aagataaatggtgcatgttctcaatgagcttgtatattaaagaaaaattacaaatgggatgaatattacattgtgaaggttaatattaagtaagtgtcaacttgattggattgaaggatccaaagtgtttttcccggttgtgtctgtgagggtgttgccaaaggagattaacatttatttagtggactgggaaaggcagatccaccctcaatgtgggtgggcaccatactatcagctgccagcatggctagaataaagcaggcagaagaaggttaggagaagctgacttgctgagcctactggccctcatctttctcccatgctggatgcttcctgcac

SEQ ID NO: 11594 - DNA, 339 bp, Homo sapiens
attcacaaaaacttttgccacacttggtgcctaggccctgttcctaataaccccttctagggccgtttatccaacatttagatgccttcttttccctccctaatttgtagccagtccaacctttcattccttggaggatttagttttgggataaaattttggtccttgggcacagagacattcactattaatgaagtaacccttgggcatgactccaatcccagaattgctcactgagcgctatgccaccgaagcgttgacctgaacatattagtgcaatccagtccagattggacctttgatcctatgtggaagggctgttttttaagaaaaaatttt

SEQ ID NO: 11595 - DNA, 172 bp, Homo sapiens
ggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtatta

SEQ ID NO: 11596 - DNA, 189 bp, Homo sapiens
tggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagctttt

SEQ ID NO: 11597 - DNA, 334 bp, Homo sapiens
cacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacagg

SEQ ID NO: 11598 - DNA, 305 bp, Homo sapiens
  misc_feature 255: n = A,T,C or G
ttcggcacgagggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgttgggggccccgggtgtacatatataatgtataattttttcaaatgntgtcgggagtgcagcccatgttccctgcgtgcagctcacggccttgtgtg

SEQ ID NO: 11599 - DNA, 338 bp, Homo sapiens
ctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacat

SEQ ID NO: 11600 - DNA, 339 bp, Homo sapiens
ctcgtgccgcacttgtccaatcctcaatcctgttcaacagccaaggccaaagaaagctgataagaaaactgaaaccttacacgccaacctgcttccttggctactttggaaaagaaacaatcctattgggtatccctgcatattcattcattcttaattcatgcatacatttactcattcatcagtcatatattttagaacaccaaaactagcactaaagtattgtattttctttttctatggatacaaaataaactccgtgttctcagacgtgtagcaaagtagatgtcaaaaccctagagataggaaaataaaatataaatgctaataagaggttta

SEQ ID NO: 11601 - DNA, 339 bp, Homo sapiens
gcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgg

SEQ ID NO: 11602 - DNA, 304 bp, Homo sapiens
ctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagatt

SEQ ID NO: 11603 - DNA, 334 bp, Homo sapiens
ttcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtgggggggaatgagcatgaactgtcctt

SEQ ID NO: 11604 - DNA, 335 bp, Homo sapiens
agtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatca

SEQ ID NO: 11605 - DNA, 325 bp, Homo sapiens
  misc_feature 233: n = A,T,C or G
ttcggcacgaggacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaaagtggtccaaaggcaaagttcgggacaagctcaataacttagtcttgtttgacaaagctacctatgataaactctgtaanggaagttcccaactataaacttataaccccagcttgtggtctctgagagactgaagattcgaggctccctggccagggcagcccttcaggag

SEQ ID NO: 11606 - DNA, 338 bp, Homo sapiens
cctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattga

SEQ ID NO: 11607 - DNA, 334 bp, Homo sapiens
cttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggggttgttgatcttttttttccttacagacacccat

SEQ ID NO: 11608 - DNA, 336 bp, Homo sapiens
ctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatggg

SEQ ID NO: 11609 - DNA, 290 bp, Homo sapiens
  misc_feature 271: n = A,T,C or G
gtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgngacgctgaataaatgtctt

SEQ ID NO: 11610 - DNA, 179 bp, Homo sapiens
ttcggcacgagaatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtg

SEQ ID NO: 11611 - DNA, 332 bp, Homo sapiens
cgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaaggggactgtgatccagaggctcagaataaaaagatgccctcccttctatgcaggggggcaagtttactggatggagatgatttgggcctctcttccagaagaagctaaaggaagagaaggggagtgagagttcagg

SEQ ID NO: 11612 - DNA, 324 bp, Homo sapiens
  misc_feature 4: n = A,T,C or G
aacnaagctggagctcgcgcgcctgcaggtcgacactagtggatccaaagccagactggagtgcaatggcactaccttgattcgctgcaagcttcactttctgggctcaggtgattctcctgcctcagcctcctgggaccaaggattacaggcgcatactaccactcctgactaatttttgtatttttagcagagatggggtttcaccatgtgggtggatcacgaggtcaggagatcgagaccatcctggctaacacagtgaaaccccgtctctactaaaaatacaaaaatttagccgggcataggggcggggcgccttggggt

SEQ ID NO: 11613 - DNA, 247 bp, Homo sapiens
gaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaccttcttctta

SEQ ID NO: 11614 - DNA, 335 bp, Homo sapiens
caggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcga

SEQ ID NO: 11615 - DNA, 323 bp, Homo sapiens
gacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacacctcagccaggctgctgggggatg

SEQ ID NO: 11616 - DNA, 338 bp, Homo sapiens
taaagctgaatcctgggcataagaagctatgtactgtagttgaaagtgaagtaaatgtcaatgtaggctagtctctagagaaatgtcttctataaagattcagggtttttttgcaccattatgatcaccatactgtgccaatgacatagttactcatgagcatgtccagtctgtctacattaatgaaggataatgcagagatcacaggctggagagttacatctgacagagaagtgctgcactattggggcatattctttcctgctattcctttaacagttccattctgaaccttacaggaagtaaaataagttatgtctggtaaaatatacgttgca

SEQ ID NO: 11617 - DNA, 161 bp, Homo sapiens
  misc_feature 44, 57, 87, 108, 136, 138, 155: n = A,T,C or G
gtccatacggcgttgttctggattccccgtcgtaactttaaaangggaaaatttttnaccaatgtcccgggagccccctttggatgntcctgcaaatgaagggagggnggatgggccctttaaagtttccttgccncnaggaaccccccctttangggggg

SEQ ID NO: 11618 - DNA, 337 bp, Homo sapiens
gtaatcccagctactcggaaggctgaggcaggagaatcgcttgaacctccacctcctggattcgggcgattctcctgcctcagcctcccaagtggctgggatttcagacatgcgccaccacgcctggctaatttttttgagacggagtctcgctctgttgcccaggctggagtgcagtggcatgttctcggctcactgcaagctccgccttccgggttcatgccattcttctgcctcagctactcgggagcctgaggcgggagaatggagtgaacccgggaggcggggcttgcagtgagaccagatagtgccaccgcattccagcttggatgactga

SEQ ID NO: 11619 - DNA, 312 bp, Homo sapiens
gtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaaga

SEQ ID NO: 11620 - DNA, 327 bp, Homo sapiens
gtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttataggttaagttcattcagacataattatataaaaactacgtggat

SEQ ID NO: 11621 - DNA, 369 bp, Homo sapiens
  misc_feature 16, 17, 23, 43, 45, 47, 52, 70, 311, 330: n = A,T,C or G
cccaaactaaaggctnnaatggnagtgcaagaaggaggatgantnanaaggnggctactccaaagacgtnctcctacggcttttgcagaagtatggtgaggttctcaacctggtgctttccagtaagaagccaggcactgctgtggtggagtttgcaaccgtcaaggcagcggagctggctgtccagaatgaagttggcctggtggataaccctctgaagatttcctggttggagggacagccccaggatgccgtgggccgcagccactcaggactgtcaaagggctcagtgctgtcagagagggactacnagagcctcgtcatgatgcncatgcgccaggcggccgagcggcaacagctgatcgcacg

SEQ ID NO: 11622 - DNA, 329 bp, Homo sapiens
ggacagagtaagcacccattgtccatttacttacttgtatttattttaatctaaaggaattcagaacatatcatccccaaatatgccattttggcacattagttattttgagcttaaaaaattgagaaccagccaacacagtaaaagttctttacctccccctcaactgcctaaaatataaatttcccctttgtaaaggaaatgtacatctattttaaatttttcattagtaaaaatatcagtaccaggaaaaaaatctattctgagataactttatcacctgaaagacttttatcttcataacaatgcaatttttattcatcatcttc

SEQ ID NO: 11623 - DNA, 334 bp, Homo sapiens
attttttaatttccatcttgatttcatttttgacccaatgtttattcaggagcagattatttaatttccatgtatttgcatgcttttggagttgattttcagttttatttcactgtggtctgagagtgcttgatatcatttcaattttcttaaatttattgagccggtctatcttggagaaagtttcatgtgctgttgaatagaatgtgtattctgtggttgttgcatgaaatgttttgtatatatctgtttagcccatttgttccaaagtatagtttaaatccattgtttctttgttgactttctgtcttgatgacttatctagtgctgtcag

SEQ ID NO: 11624 - DNA, 339 bp, Homo sapiens
ctcgtgccgttaaatttctccagagtatctctttcgttgaattttagcgggaacgcatgctgtattatgtctacttttgagaagtgaagattttctttaatttttgtaaatcttactcatggcatttgaaaaaagatgtggtatgagatatgtaatatacgcatacaaccaagcttattaaccatgcctttaattcccccatggcctttcccatcctttgattatatggcctgtcagttactgagtaacatgcaaggtactctgttaagtggtttacctccattaatccccacacgggcttacaacagcctacttattcccctctgggatacatgtggg

SEQ ID NO: 11625 - DNA, 243 bp, Homo sapiens
  misc_feature 172, 199: n = A,T,C or G
ttcggcacgagaatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctnccaacctgatccaaaagccagtcttangagtttacccctgggatggggggatgcttctgcccctgactttt

SEQ ID NO: 11626 - DNA, 265 bp, Homo sapiens
ttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatg

SEQ ID NO: 11627 - DNA, 335 bp, Homo sapiens
  misc_feature 152, 334: n = A,T,C or G
gtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggnggaagaacggtctcagaactgtttgtttcaattggccatttaagtttagtagtaaaagactggttaatgataacaatgcatcgtaaaaccttcagaaggaaaggagaatggttttgtggaccactttggttttcttttttgcgtgtggcagttttaagttattaagttttttaaaatcaagna

SEQ ID NO: 11628 - DNA, 156 bp, Homo sapiens
ttcggcacgagctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagt

SEQ ID NO: 11629 - DNA, 235 bp, Homo sapiens
gagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagcccctggactcatcatcaataaacactgttacagc

SEQ ID NO: 11630 - DNA, 283 bp, Homo sapiens
tagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatg

SEQ ID NO: 11631 - DNA, 203 bp, Homo sapiens
cctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcattaaaag

SEQ ID NO: 11632 - DNA, 338 bp, Homo sapiens
aaagaagggattggctaagaaaattatagcaaattgagacagtttaaatttttttaaaaaagaaaatgcgagtcagttgtagttctttctttcttacccttttttgctatgtgaaatttgtgcttcctaggtctctatggaaagctgccaatcattatgtttcccaaaaaatcttccatcctttttttactttcttgacctcaccaaaacctgtctcctaaagatatggcctcagttctcctgactttatgggaaagatagatgtcataatatacattcttctcagtactactttccagctttgaattggccaagttcccattttttggtgttcctag

SEQ ID NO: 11633 - DNA, 335 bp, Homo sapiens
aataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgc

SEQ ID NO: 11634 - DNA, 340 bp, Homo sapiens
ggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtac

SEQ ID NO: 11635 - DNA, 101 bp, Homo sapiens
  misc_feature 8, 20, 55: n = A,T,C or G
agtacttntagagcggccgngggcccatcgattttccacccgggtggggtaccanggtaagtgtacccaattcgccctatagtgagtcgtattacaattca

SEQ ID NO: 11636 - DNA, 338 bp, Homo sapiens
gctgtgcggaatatgtcctacatggagaagggcacaatgactggggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcaagaagaagatctgtg

SEQ ID NO: 11637 - DNA, 339 bp, Homo sapiens
ggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcg

SEQ ID NO: 11638 - DNA, 181 bp, Homo sapiens
catgcatgttcatcatgttagtgtcgtattttgagctggggttttgagactgcccttagagatagagaaacagacccaagaaatgtgctcaattgcaatgggccacatacctagatctccagatgtcatttcccctctcttattttaagttatgttaagattactaaaacaataaaagctc

SEQ ID NO: 11639 - DNA, 339 bp, Homo sapiens
ccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatga

SEQ ID NO: 11640 - DNA, 189 bp, Homo sapiens
tatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctat

SEQ ID NO: 11641 - DNA, 210 bp, Homo sapiens
ggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgag

SEQ ID NO: 11642 - DNA, 335 bp, Homo sapiens
taactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtc

SEQ ID NO: 11643 - DNA, 334 bp, Homo sapiens
  misc_feature 15, 107, 136, 264, 324: n = A,T,C or G
ttttttttttgtagngtctttgacttcggtatcatggtaatgatggcctcttaaaatgagtttgaagttttctctcatcaattttcaattttttgagagagcttganaaacactggggtttattctttaaatattnggtagaattcaccagtaaaggcatcaggtcctgggttgttttttgggcagtctatgactgctgattcaacttccttaattagtagtttatacagattttcaacttcttcatgattcagtcttgataanatgtatgtttccaggaatttaggttatctaatttgttggcatatgattgctcatagttgnctcttatgat

SEQ ID NO: 11644 - DNA, 338 bp, Homo sapiens
aagatggagaaataaggagtgttctatgttccctgactcacaaaagaacggtctggagtgactctattagtaggattcaaagggaaaggtgagctaaaggcacattatatccagagaattaaatttcaaaatgaggcataaaaaatttaacctgaagaattagaaactcattcaagggaagatggccgaatagaaacagctccagtctatagttcccagcataagcaaccagaagacaggtgatttctgcatttccaactgaggtaccgggttcatctcactggggagtgtcagacagtaggtgcaggacagtgggggcagcacaccgtgcacaagcc

SEQ ID NO: 11645 - DNA, 328 bp, Homo sapiens
ttcggcacgagacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaatacca

SEQ ID NO: 11646 - DNA, 277 bp, Homo sapiens
gggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatg

SEQ ID NO: 11647 - DNA, 337 bp, Homo sapiens
ctggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgg

SEQ ID NO: 11648 - DNA, 242 bp, Homo sapiens
  misc_feature 203, 218, 240: n = A,T,C or G
gctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcangtatccaaccaactnggttctgcttcaataaatcttngg

SEQ ID NO: 11649 - DNA, 328 bp, Homo sapiens
  misc_feature 94, 219: n = A,T,C or G
ttcggcacgagggcgacatggccaaacgtaccaagaaagtcgggatcgtcggtaaatacgggacccgctatggggcctccctccggaaaatggngaagaaaattgaaatcagccagcacgccaagtacacttgctctttctgtggcaaaaccaagatgaagagacgagctgtggggatctggcactgtggttcctgcatgaagacagtggctgggcggngcctggacgtacaataccacttccgctgtcacggtaaagtccgccatcagaagactgaaggagttgaaaagaccagtagacgctcctctactctttgagacatcactgg

SEQ ID NO: 11650 - DNA, 339 bp, Homo sapiens
agtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatgggtgagttcaaccatttttgctcttgaattgatgcccttcgatgtatgccatttagtgaaagtgctaagtctta

SEQ ID NO: 11651 - DNA, 331 bp, Homo sapiens
tccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaaaaaaagagtacttctagagcggccgggggcccatcgattttcca

SEQ ID NO: 11652 - DNA, 339 bp, Homo sapiens
ccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctagagt

SEQ ID NO: 11653 - DNA, 193 bp, Homo sapiens
  misc_feature 168: n = A,T,C or G
cgcactttatctctaacaccaccaccttcacttttccataacagtaaataaaaagtgtagcctcttctcactagctattatttcactttggctaagttcccaggccattatacagctgagaaacactgtgaaactgctgcttatcacttttacacatttacttctggngctggctatatgaataaggggcaga

SEQ ID NO: 11654 - DNA, 339 bp, Homo sapiens
ggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctaccta

SEQ ID NO: 11655 - DNA, 397 bp, Homo sapiens
aaagctggagctcgcgcgcctgaggtcgacactagtggatcaaagaattcggacgagtgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccggggaattgaccccttcctccaggggtcttgggtgggggagcccaggg

SEQ ID NO: 11656 - DNA, 332 bp, Homo sapiens
  misc_feature 10: n = A,T,C or G
caaagaaccntccataggtctagatggcattttcaagattttattatccagttcctcattttgctaaggagaagcctatgagatttcatgatttgcccagagctattcagtgattgataaaagagccagctcaatgagccaagtcttcccaccctgaggcctgtgcatggttactttttttttcctttctcgtcatcataatattgcattaaatatactcaatttgttagcttattttaaatatctttttggaaattttagatgttaattattcagcagttacattctgattgagttttgttaagaagagtagaataacggtgtcacaaatg

SEQ ID NO: 11657 - DNA, 328 bp, Homo sapiens
gcagaatctcagcagatcggaaactgctcctcgcctggctcttgatgtccaaggattccatcggcaagacttctcagatccttggggaaggtttcaagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataat

SEQ ID NO: 11658 - DNA, 340 bp, Homo sapiens
taaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatggcattgatatgaaccatggacaagtatattctgctgccacaaagactgtaaagtgcttcatttcaacagctgaggcaagccaagtgatcattaataaagcttttcttggttccttcagtggtgttggtagtaaaatggaaggtgtcttgctgcaggtaactaatgaagaagtggt

SEQ ID NO: 11659 - DNA, 336 bp, Homo sapiens
ttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaag

SEQ ID NO: 11660 - DNA, 341 bp, Homo sapiens
ctctgatccaaagtgtttctcagggagagcggccaagtgagcacaggagccgctcggccgtctgggactgtgatgtgatgtctgaacagcctctttagaaacactgcagccttttccagggatgccatccagacggggacatccctcacaagttgtctagggtcctggggatggaggccgggagctccggatcgagggatttagccttatggggcctggttggccccgccaggccagctgtgaatgaggagggtgtctgagctctgttttgcacccgtccactcaccaacttattcttgacctaacacaccatgcccctgctgcccttggctgtgacgatg

SEQ ID NO: 11661 - DNA, 339 bp, Homo sapiens
gcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgtttt

SEQ ID NO: 11662 - DNA, 339 bp, Homo sapiens
  misc_feature 258: n = A,T,C or G
aaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggnggaagaacggtctcagaactgtttgtttcaattggccatttaagtttagtagtaaaagactggttaatgataacaatgcat

SEQ ID NO: 11663 - DNA, 332 bp, Homo sapiens
actcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccat

SEQ ID NO: 11664 - DNA, 337 bp, Homo sapiens
  misc_feature 133: n = A,T,C or G
atttttggtccgcacgctcctgctcctgactcaccgctgttcgctctcgccgaggaacaagtcggtcaggaagcccgcgcgcaacagccatggcttttaaggataccggaaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgag

SEQ ID NO: 11665 - DNA, 247 bp, Homo sapiens
cagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttatta

SEQ ID NO: 11666 - DNA, 325 bp, Homo sapiens
ttcggcacgaggagaagagaggagccgtcagaacatatgggggatgtgttcaagaagcagatttgtggtcggaagctttgcaaagaggggacctgggtctgagtgacatgcgtggccactggtgctcctgcgtttggactgtgcaggcctctcctatgctgatgcgtctccccactcctgagctaatttctgctctgctccttctgtgacatgtggcagcgtgggaaatagccactgtcccctgtccctgctgttcctggtgtcacccagcaccaggccactctgggagccagggcagatggtcctccctgtggtcctggcctct

SEQ ID NO: 11667 - DNA, 361 bp, Homo sapiens
ttcaagaatcacaaatgacagtgacaagaaagaagtgctctctgttgctaggtcagtccttccacagactggagctatctgagcaaaatatttagaattttgctcagattttgccccagagacattcttctagactggaggggatagagaaaggatgggaaggtataagtgagcttctgagatcaattcacatgcttctattagctgaatgtggcccttattctatttttaaatcatttagataaaatgtgacaatggatgcatataaaggaacatttaattctacttttaaagtgatccttgttagaacagatttatttttcccaaatctgaagtgatttatcttattcctagtcacttt

SEQ ID NO: 11668 - DNA, 339 bp, Homo sapiens
tatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtgggtttgactatttctgtatgtc

SEQ ID NO: 11669 - DNA, 339 bp, Homo sapiens
tgaaaaaatttccaatccaaaaacactccgtaaggaagttgggaataaatcaaaagaaagcagaagggagaaaataataactataagagcaggaatgaatgtggcagaaaatagaacagtagaattaagaaataagtgaaaagccagttcttaaaaatataggtcatcaattagacaaatgattatcaaaactaaggggaaaatgtatatatttgtggggaaagttacaaatgtacaaaacaagagatggcaatggataaacaccaaggaataatgaaaatttaaaaatcattaaggccactttatactactctatgcaaataaactttaaaatctaac

SEQ ID NO: 11670 - DNA, 102 bp, Homo sapiens
gccagcttctatttgaagattgcctttgcactcagtgtaagtttctgtcagcagtagtttcacccatttgcatggaaaaatttaaagctaataaagcaattt

SEQ ID NO: 11671 - DNA, 337 bp, Homo sapiens
aagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagt

SEQ ID NO: 11672 - DNA, 140 bp, Homo sapiens
ggcgtgttggtgcatgcctgtagtcccagctatttagggaggctgaggtgggaggatcgctggtacccaggatggggaggttgcagtgagccataattgcaccattgcactccagcctgggtgacagagtaagaccctgt

SEQ ID NO: 11673 - DNA, 337 bp, Homo sapiens
ggatttttttctgacttcctacagagataatcttatttttaggcaataatgacaattttgtttctcccttttcaatctttacgactccttttccttcctttatccctcctgcccttccttctttccttcctttcttcccatttttctctttttctttctcccctctttcctctttcccttcccgatttttatttctcccactgcccccttctctctttattgtcgtacataggacctctgtgcaatgttgactataagaggtgaaaacaggcctggcacagtggctcggacttctaattccagccctttgagaggccagagggggacgaccacttga

SEQ ID NO: 11674 - DNA, 336 bp, Homo sapiens
gcttgaccatgctgattctgcaggtgcccatatgccacacgtatgttttcttgagcacacagcttcactcaaagccaggctcaggcgcacctgtttttcacctgctggtgtgttctctgtgggaaggaggacagtcccttgtcctgtctctcagataatgagacaggatgccccaggacactagacaaggacaggggagcatgggattatcttccctcttctgcccctagctcccactgggccctcatatgggggaaagttcattaccttgtgtcagactgaatgatgtttgaaagactgcaggctgtagtttctgagtggagatgtattttgaga

SEQ ID NO: 11675 - DNA, 340 bp, Homo sapiens
  misc_feature 139, 211, 257: n = A,T,C or G
ttttttttttatgtttatggctcttccatttttttatgtttatggctctcccattttttctttgctttctaactgactctgaacaacttcttggaaaaacaaatgatcacagaataacctcatttggaagagagaccgngtaataaaatagagagctggagcttcattcccccatgcctagccaataaaatactaaatcttactttccagngagaccggtaagaggattccacagtcctgggacacttcctgagagngggaacacctggtaccaaggaaggagcaaccgctgcctgcaaagctgaagctgccgagtgtgggacccactcccaagccctga

SEQ ID NO: 11676 - DNA, 337 bp, Homo sapiens
tgaggcccccattccaggccctagctccccaatgatatttctagacacactctgggccaaaagggaaccggctgccttgaagagaaggatccagtcctggcaggactcatcacctgctgactaaagagttcttgggcaatgaattgccactgggcaccagcaatacccagggagtatgcttgtgggcctttgaggtctgagactacttgcttcaaaggagacccagcacattcccagttgtggtggccactgtgaaagactccttctgtctgagaaaagcagagggaaaagtaaagggaactttgtcttgctttcaggtatcacagtgggacagaac

SEQ ID NO: 11677 - DNA, 323 bp, Homo sapiens
  misc_feature 9, 41, 44, 70: n = A,T,C or G
gaaaaatgngaaaaggtgaagaccatggaggtgacttcagnatncatagagctggaaaagaacttcagcnattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagaccca

SEQ ID NO: 11678 - DNA, 337 bp, Homo sapiens
aaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattctt

SEQ ID NO: 11679 - DNA, 339 bp, Homo sapiens
ggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagctctatgctgtgggcgtggaccgggcagacatggcgtccctcaagatgatggccagtgagcccctagaggagcatgttttctacgtggagacctatggggtcattgagaaactttcctctagattc

SEQ ID NO: 11680 - DNA, 292 bp, Homo sapiens
aaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaaga

SEQ ID NO: 11681 - DNA, 282 bp, Homo sapiens
cgggtgcggtggctcacgcctgtaatcccagcactttgggaggccgaggtgggcagatcacgaggtcaggagatcgagaccatcctggccaacacagtaaaaccccgtctctactaaaaatacaaaaattagctgggcacggtggtgcattgcctgtaaacccagctaccaggtactcgggaggctgaggcaggagaatcgcttgaaccagggagtcggaggttgcggcgagctgagatcatgccactgcactgcggcctggagacaagagcaagactccgt

SEQ ID NO: 11682 - DNA, 340 bp, Homo sapiens
cacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccat

SEQ ID NO: 11683 - DNA, 197 bp, Homo sapiens
ggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctg

SEQ ID NO: 11684 - DNA, 325 bp, Homo sapiens
ttcggcacgagcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatga

SEQ ID NO: 11685 - DNA, 234 bp, Homo sapiens
actgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 11686 - DNA, 156 bp, Homo sapiens
  misc_feature 155: n = A,T,C or G
ccccgctcaggctgcagagtccgtggagcactcccttgccggccccccttagctcagctctccaacagcctgggagttaattatacactgacgtactttgtttttaaaaacatgtttatttttgctctgactcattgtagaaaatttagaaaatnc

SEQ ID NO: 11687 - DNA, 340 bp, Homo sapiens
ctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaag

SEQ ID NO: 11688 - DNA, 339 bp, Homo sapiens
taattctgaatgtactcaagagataattttctggaaagtaacttggcttctgtagttctgttttacatctgaattgtggcaaatgagttttaaaaacaagaccttgaaagtgaattatttgcaacgtgaaggaccgttcactagtttctgtttcataaaactgagcttagaaaaatgtggcctaaatactctgtaagttccttttagtcctaaagatctatgactttcttacatgcagaatccaagtatatataggtgtgtacaattagatcattatgcagggggaaaatcaaggaaaggataaaacatctgaaccaaaaagtgtatttagtgttagtt

SEQ ID NO: 11689 - DNA, 253 bp, Homo sapiens
ttttagtatcctatttctttgagcaggacttgccatttctaagccatcagtgatttccctattggaacaagggaaagaaccctggatggctgggaaaacagggtggtatccaggtgggtaagggtgttggggtactcccagcagaagtgcattttagggaagcccaaactggtcagagtggtgatgtcttttgtttgagatattgtgtggaaaccttccctcagaggcccaaggtcttgggagaaaaagtttg

SEQ ID NO: 11690 - DNA, 224 bp, Homo sapiens
  misc_feature 10: n = A,T,C or G
ttcggcacgnggtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgta

SEQ ID NO: 11691 - DNA, 310 bp, Homo sapiens
  misc_feature 24: n = A,T,C or G
actagtggatccaaagaattcggntcgagtctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctg

SEQ ID NO: 11692 - DNA, 294 bp, Homo sapiens
gtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttat

SEQ ID NO: 11693 - DNA, 344 bp, Homo sapiens
  misc_feature 299: n = A,T,C or G
cagaaaacattacgtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagngctctatgtgggcagaacatgctctccttgcctctcctggaaggt

SEQ ID NO: 11694 - DNA, 276 bp, Homo sapiens
  misc_feature 11, 13: n = A,T,C or G
ggacaccgggncnagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgag

SEQ ID NO: 11695 - DNA, 292 bp, Homo sapiens
tgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcac

SEQ ID NO: 11696 - DNA, 340 bp, Homo sapiens
cttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatg

SEQ ID NO: 11697 - DNA, 328 bp, Homo sapiens
gaaaagcactttgtttaaattctcatatttgactattgtgacaggaaaataaatctcaggactcaaaaatcactaagccaaagggaaaagtcaagctgggaactgcatcaggcaaacctgcctctcattttattcctaactaagataactacaaagatttaacaagctacatacctccctcacaatttgcccactaggaaatttttgtgggccccaaaatctttaccctgaaatagttctgtcaaatttcattctgacaatgtaaattgatagcttatcttcacaggtgtgagacaaagaacagaactcaaaatcatccctctgctca

SEQ ID NO: 11698 - DNA, 216 bp, Homo sapiens
caactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacg

SEQ ID NO: 11699 - DNA, 235 bp, Homo sapiens
  misc_feature 224, 225: n = A,T,C or G
cagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatggnnggcctggaga

SEQ ID NO: 11700 - DNA, 333 bp, Homo sapiens
cttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttaaaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaag

SEQ ID NO: 11701 - DNA, 322 bp, Homo sapiens
  misc_feature 160, 226, 229, 272: n = A,T,C or G
attttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgnacagatagggattaaggaatacagactattagagaagatccttatatttacatctagtatatatgnggnaaggaaatgccgattcttcattataaacaagttttaaaattgntctttcttagttcaaatgatagcaatacccctatagcattaggtagaaac

SEQ ID NO: 11702 - DNA, 368 bp, Homo sapiens
cgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccactttaactgtgaaaaaagatatttgtt

SEQ ID NO: 11703 - DNA, 336 bp, Homo sapiens
taatccagtctgtgattttttagacatcagaagatatctgtttcagagggtacctcaacacaggggctgctggcagggttttagactaggggcttagtgggcttactcggcttaatcctgtgaatgtttcatgtttcagggacagaaaggagaacctggagacatcaaggatattgtaggacccaaaggaactcaagggagggcctaaagcacttgtaactttgaaccgtctgtctggaggtcaagagcctgttggaaagcaggggtagaggggagccctggaagcagggcttttccggatgcctaggggtgggcagtgccagcccctcctcacca

SEQ ID NO: 11704 - DNA, 308 bp, Homo sapiens
  misc_feature 128, 250: n = A,T,C or G
ctttagaataagcatgtaccattctttatccattccccttattcctacatcaattgtttttactttcttgggtgtgagactgagtgagacacacacaaaatgtgttgacactgtgatgccggcaggcngagcagctactgactttgaacatgggcaagagaggcccctggatctcatccagcccactccttttccccttccagtacagggacactctggtgcccattggcaagatggcgacttccctgcncccataactgatgctttgggaattcttcctccttttcagaactactctgtgctaattg

SEQ ID NO: 11705 - DNA, 286 bp, Homo sapiens
tctgtgaaacatttttttttctttgaggcagagtctcactctgtcgcccaggctggagtgtagtggcatgatcttggctcactgcaacctccgcccccaccctgggttcaaacaattttcctgcctcagcctccctagtagctgggattacagacgcctgccacaatgcccggctagtttttgtacttttagtagaaacagggtttcaccatgttggccaggctggtctcaaacttctgacctcaggtggtcctcccgcttcggcctcccaaagtgctgggattac

SEQ ID NO: 11706 - DNA, 352 bp, Homo sapiens
attttcctgaggcttcccagccatgcttcctttatagcttgccaaactgtgagtcaactaaacatttttctttataaattacccagtctcaggtagttctttatagcagtgtgagaacggattaatacaagcattttgaaagccagtttctccaattattaaaagtttttggaggctggcaagatggatgaataggaacagctccagtctgcagctcccagcaagatcaatgcagaaggcgggtgatttctgcatttccaactgaggtaaccggttcatgtcattaggactgattggacagtaggtgcagcccatggaaggtgagccaaagcagggtggggtgtcatctcac

SEQ ID NO: 11707 - DNA, 304 bp, Homo sapiens
gaaaaacagaaaaaattcaaaaatcatatttctggtaatcgatacaccattgctggatattaaatattaataaatattttttcacgatttttattttgtagatggtcatttgattaaaatgttaggtaaagtagagcaattcagaaatatttcacccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctca

SEQ ID NO: 11708 - DNA, 361 bp, Homo sapiens
  misc_feature 12, 108: n = A,T,C or G
acagaggagaancaatgggtcttagctctttctctattatgttatcatcctcccttttttgtacaatatgttgtttacctgaaaggaaggtttctattcgttggttgnggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaacctt

SEQ ID NO: 11709 - DNA, 326 bp, Homo sapiens
  misc_feature 22, 301, 320: n = A,T,C or G
gagagagttggttggtgttggnccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaanaacactatgtggctgccgngtaaga

SEQ ID NO: 11710 - DNA, 157 bp, Homo sapiens
aaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacat

SEQ ID NO: 11711 - DNA, 325 bp, Homo sapiens
cgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacac

SEQ ID NO: 11712 - DNA, 102 bp, Homo sapiens
  misc_feature 94, 101: n = A,T,C or G
ttcggcacgagtatctacaaaagatgtgaaagcacttaaaaataccatttttaagcagtacttttacctgttttttctttagcaaaccaggttnatgtggng

SEQ ID NO: 11713 - DNA, 308 bp, Homo sapiens
  misc_feature 1: n = A,T,C or G
nataaaatcacagtggcaagcattgaggaaactgacagccagttttagcatttagactatacagaggctagcttcagtccttcagggagacagttcagattctcagagtgaagagagtatgataacacacagccaagcctggggtgaatccccacaaaatgccaattaaagaaaattcttgccatttattatttagagttattttattttattttatttttgagatggagtctcactctgtcgccaggctgcagtgagccatgatcgtgccactggactccagcctgggtgacaggagcaagaccctg

SEQ ID NO: 11714 - DNA, 334 bp, Homo sapiens
  misc_feature 252, 280: n = A,T,C or G
ctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttnggggggtcttggaacagcttctctatgngtggattcgtgtaaatgcgaagagttcacatataaagaagtgactttgattctg

SEQ ID NO: 11715 - DNA, 344 bp, Homo sapiens
gtgagttgtaaagagaagtattattgcattgtaggtttttgcattgatgtgtcaatttttttgttttgtcccaagatttccttccagcaccttaatgaatgttcatatgatagaatgttttaagtatcagcaaagcattcatggatgcctgcttttcattctcagaaggctaaacctgttttgggtatgatgctacttcagaacatattgtctggcacaagatttcttctaataagtggtttatttaaactcaatttcggtggactgttgaattgaaaaacaccaaaggagtcttcttgtctggagactggattgttccagttttaaatacctgtgcccataag

SEQ ID NO: 11716 - DNA, 342 bp, Homo sapiens
ctgcgacagactctagaataaataagccccaagtttccaccttatctcaactgtaatgaatgcataatggaaatgaaatcatagctatgtatccatttcatttgacattttttatgggttaaggaaaataagaagagcagactcagatcagcactttcccggcagacaagtcagaaaaaaaatgagctagttagttgtgctttatggatcaattcttaaaacaaatggaagggttcactccacgcattcatccatttagacttataaataaaaactaagtgagaagcattcagtcactcttcagaaggctttgcttgagaactgagggatgtgcctctcaaa

SEQ ID NO: 11717 - DNA, 286 bp, Homo sapiens
ttcggcacgaggttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgc

SEQ ID NO: 11718 - DNA, 246 bp, Homo sapiens
  misc_feature 152: n = A,T,C or G
ttcggcacgaggccgccagaacacaggtgtcgtgaaaactacccctaaaagccaaaatgggaaaggaaaagactcatatcaacattgtcgtcattggacacgtagattcgggcaagtccaccactactggccatctgatctataaatgcggnggcatcgacaaaagaaccattgaaaaatttgagaaggaggctgctgagatgggaaaagggctccttcaagtatgcctgggtcttggataaactg

SEQ ID NO: 11719 - DNA, 157 bp, Homo sapiens
agaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagt

SEQ ID NO: 11720 - DNA, 206 bp, Homo sapiens
cctcatcttcacgctgagtagtctgaggagcaagaggagttggtctttctgtcccagtggcagaggtggaagaaaatccacagatacgtggacctgcgcagttcaaacctgtgttgtttgggtcaactgtattgtaatagcattttaatgtttttctcagacttttacgagtatgaatctgagctttttctgaataaacctgcctg

SEQ ID NO: 11721 - DNA, 346 bp, Homo sapiens
  misc_feature 167: n = A,T,C or G
cctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcnggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattg

SEQ ID NO: 11722 - DNA, 244 bp, Homo sapiens
gcgcagcccagcctcgaaatgcagaacgacgccggcgagttcgtggacctgtacgtgccgcggaaatgctccgctagcaatcgcatcatcggtgccaaggaccacgcatccatccagatgaacgtggccgagggtgagtcagatgattccattctccgattggccaaggccgatggcatcgtctcaaagaacttttgactggagagaatcacagatgtggaatatttgtcataaataaataatg

SEQ ID NO: 11723 - DNA, 315 bp, Homo sapiens
ttcggcacgagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgt

SEQ ID NO: 11724 - DNA, 331 bp, Homo sapiens
gtcatctaatgcaaacgctcaacctttttaaatggttaatgtgagaaaggcactgaattaagatatcttagtgttattttatttactcaattttcatctttcacactgtaagaataaaatgtttttgtggttaagttcctgatactatatagagataaactttaaaactttaacacctaggataatgtgggtgattacataaatgtttaaaaacatttaccttatatggaaagcagatttctgactaagatgccatgattcattctagtttgatattttaaaactttgccaagagcactctttaaaactgatttcaaatttgaacagatac

SEQ ID NO: 11725 - DNA, 228 bp, Homo sapiens
  misc_feature 118, 161, 164, 175, 197, 199, 225: n = A,T,C or G
ctagtggatccaaagaattcggctcgagtccatcacaaagaccgcctttatctttctagtccttttggttttaacagggaattgagctggggtgggggtagggtctggggcgaaggangaaaaggtgttttttagacctgctacaccagaaaggtactggnagntgaatcattgngaatcccactgaatcaccgtgngncccactggggtgactacttgaaacgngga

SEQ ID NO: 11726 - DNA, 112 bp, Homo sapiens
atagaatcccatagtatagatgtaccacagtttgtttaactgttcacctgctgagagacattgggccagtttttggctactataaataaagttgctataaacatttgtgtac

SEQ ID NO: 11727 - DNA, 166 bp, Homo sapiens
ggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggtt

SEQ ID NO: 11728 - DNA, 110 bp, Homo sapiens
  misc_feature 3, 4: n = A,T,C or G
gtnngtgcacgtgcgcctgagggtgggcatgagtcttgccagaatgtgagtgtgagagtgataatgcaggggtgagtgtgagagggactgcgtttgcatttttataatca

SEQ ID NO: 11729 - DNA, 290 bp, Homo sapiens
  misc_feature 22: n = A,T,C or G
atttgaaatgattttttttgtncattttggctgcagtattggtggtagaatatactataatatggatcatctctacttctgtatttatttatttattactaggacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaat

SEQ ID NO: 11730 - DNA, 102 bp, Homo sapiens
  misc_feature 3: n = A,T,C or G
gancaaacatatccatgatgcatgaataatgcgctttgaagcaagatttcaagctatcaggaagcatactatggatgctaatcatgtatagaattccatgat

SEQ ID NO: 11731 - DNA, 400 bp, Homo sapiens
  misc_feature 18, 37, 62, 240, 280, 372, 394: n = A,T,C or G
tgggaaaaaaaccggagnttgcgcgcctgcaggtcgncactagtggatccaaagaattcggntcgaggctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagncacggaggataagatcaatgccctcattaaagcagccggngtaaatgttgagcctttttggcctggcttgtttgcaaaggccctggccaacgtcaacattgggagcctcatctgcaaatgtaggggccgggnggacctgctccagcagcttggngctgca

SEQ ID NO: 11732 - DNA, 350 bp, Homo sapiens
cttttccatacttctgactagattagggttggtaaattgtaaattggtgctaagttatcctgtgctcattgtagacattaccaagtagtcacaatattttcttgctatgcttacacatagcctgagactgtttaccaagacaggagtctagacagccagaatcagttgatcagagctggtacaaaagacaaaatctgattgcatccctggatgagagtttagcctttgtattgattgtgtagtttttgtgctaatcttactcacatactccctttctctcttaatttccttaacctaggcaacaaaaaaacccacatttttaaaattaaaaattttttcaaatattttta

SEQ ID NO: 11733 - DNA, 397 bp, Homo sapiens
  misc_feature 42, 69: n = A,T,C or G
gcgcgcctgcaggtcgccactagtggatccaaagaattcggntcgagtttccctacagagatgatgtcntgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagc

SEQ ID NO: 11734 - DNA, 400 bp, Homo sapiens
  misc_feature 14: n = A,T,C or G
gcgcgcctgcaggncgccactagtggatccaaagcccaaggtttgcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctt

SEQ ID NO: 11735 - DNA, 316 bp, Homo sapiens
  misc_feature 11, 315: n = A,T,C or G
ataaaataaanccacattttataaaccatttactatggctttgtaacaattgcatacccatattttaagggacaggtgaatttactactttctaaagtttattgatacttcccttttatgtaaaatgtagtagtgatacctatatttccacattgtgcattgggacacacttgtctagggatgcctggaagtgtataaaattggactgcatttcttagagtgttttactatagatcagtctcatgggccatctcttcctcagatgtaaatgatatctggttaagtgttatatggaataaagtggacattttaaanc

SEQ ID NO: 11736 - DNA, 320 bp, Homo sapiens
  misc_feature 7, 13, 115, 117, 166: n = A,T,C or G
aaaaaangaccgngaggggcctcagtgagaccagattgtgtcatttggctccaccttcatcttgcagagccagctgatctcatattgccaagaaactagaagccacttgcacggngnggccaggagcctcagctggatgagaggctgagatgggtggccagcttgnacaccagtccctgaactgagctgtttacaggactggggaggctccacccagaaggctttcatttgtactctgctgggagtgactgggaaaaactccttccctgctgctgagtggagagaggcctcatccggctttgacccaccatccattgcag

SEQ ID NO: 11737 - DNA, 331 bp, Homo sapiens
ccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatccc

SEQ ID NO: 11738 - DNA, 328 bp, Homo sapiens
cagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttgga

SEQ ID NO: 11739 - DNA, 110 bp, Homo sapiens
agtacttctagagcggccgcgggcccatcgattttccacccgggtggggtaccaggtaagtgtacccaattcgccctatagtgagtcgtattacaattcactggccgtca

SEQ ID NO: 11740 - DNA, 194 bp, Homo sapiens
  misc_feature 128: n = A,T,C or G
gggggacccaggcctgccacatcacctatgccatgtcccgggtggcctgggaagcgctgcgaaggcagctgatggctgcagaacaggaggatgacgtggagggtgtgtgcaagcctctgtcctgcggntgggagatcacagacaccctgtgcgtgggccctgtcttcaccccagcgagcatcatgtgagtgggc

SEQ ID NO: 11741 - DNA, 335 bp, Homo sapiens
ccaccacgcccagctaatttttgtagttttactttatattttttaactcatggctgagcctctgcatctcagctggcctgggaggaggcttcctgatctatggttgagcaattggagggacagagaggggaggacaggtgaggagtcaggccgatccagcatcacctctgtgctgggtgatcttgggtgggtgccatcccttccctgggccttagtctactcttcggtcattgtggctggttgggtatagagtggcctagcctgagcccggctcacagtgagtgctcacctgttggggctgatgtggtcatccccgaagtcattaccagcctcac

SEQ ID NO: 11742 - DNA, 316 bp, Homo sapiens
  misc_feature 299: n = A,T,C or G
ttcggcacgagagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgnggtttttagtgcactta

SEQ ID NO: 11743 - DNA, 331 bp, Homo sapiens
  misc_feature 95, 297, 329: n = A,T,C or G
ctttctcgactccatcttcgcggtagctgggaccgccgttcagtcgccaatatgcagctctttgtccgcgcccaggagctacacaccttcgaggngaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgngctggaaaagtgagaggtcagactcctaaggngg

SEQ ID NO: 11744 - DNA, 251 bp, Homo sapiens
  misc_feature 130, 133: n = A,T,C or G
atttcacactgtttttaaatctagcattattcattttgcttcaatcaaaagtggtttcaatattttttttagttggttagaatactttcttcatagtcacattctctcaacctataatttggaatattgntgnggtcttttgttttttctcttagtatagcatttttaaaaaaatataaaagctaccaatctttgtacaatttgtaaatgttaagaattttttttatatctgttaaataaaaattatttcc

SEQ ID NO: 11745 - DNA, 399 bp, Homo sapiens
  misc_feature 15, 40, 43: n = A,T,C or G
gcgcctgcaggaagncactagtggatccaaagaattcggnttnagccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataaca

SEQ ID NO: 11746 - DNA, 360 bp, Homo sapiens
actagtggatccaaagaattcggttcgagggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgtt

SEQ ID NO: 11747 - DNA, 400 bp, Homo sapiens
  misc_feature 17, 42, 182: n = A,T,C or G
gcgcgcctgcaggtcgncactagtggatccaaagaattcggntcgagccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctnggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatgga

SEQ ID NO: 11748 - DNA, 400 bp, Homo sapiens
  misc_feature 13, 34, 42, 44, 358: n = A,T,C or G
cgcgcctgcaggncgccactagtggatccaaagnaattcggntngagctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggnagcctttctcatcctctttgccatgtgaaggagccgtctcca

SEQ ID NO: 11749 - DNA, 397 bp, Homo sapiens
  misc_feature 5, 7, 48, 71, 72, 73, 224, 261, 263, 305: n = A,T,C or G
ttttngngcctgcaggaaaccactagtggatccaaagaattcggtttnaggtcgcgcggaggcggaggctnnngtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagntgccaaagccttagacaagcgccaagcccatctttgngngcttgcatccaactgtgatgagcctatgtatgtcaagttggnggaggccctttgtgctgaacaccaaatcaacctaattaaggttgatgacaacaagaaactaggagaatgggtaggcctttgtaaaattgaca

SEQ ID NO: 11750 - DNA, 398 bp, Homo sapiens
  misc_feature 30: n = A,T,C or G
cttcttggggaaaaaaaaccccgagttttntgggcctgcaggacgccactagtggatccaaagaattcggtttgaggtaatatacttgtataacagacataccttctatacaaacctttttttctacttttagatagaaatgtctactttttcagcagttctgtgaattaaagagcatagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattc

SEQ ID NO: 11751 - DNA, 382 bp, Homo sapiens
  misc_feature 5, 13, 164: n = A,T,C or G
ggcanggacagcngcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagngaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagataacacctcagataaaactacattgatcaaggtctc

SEQ ID NO: 11752 - DNA, 388 bp, Homo sapiens
  misc_feature 13: n = A,T,C or G
tacctggcaaacntacgtgactagtggctaccatactggacagtgcagattagaaagttaaaaatggaagagaaagatcagaaactagattacaggaagagagagatgtgccaggcactttaagaatctaagcctacatttagctctgaaattcctggcagccaaagcaaaaagagaaaccttgggattgcagttctcatcattggattcaaaggataaattagtttgcagagacaatgaaattggcaaacaactttaaaatggaatttattactcgggaggctgaggcagttggattgcttgagcctagaagttggaggttgcagtgagctataattgtgccactgccctccagcctgggcgacagagcaagaccctgtagaccctg

SEQ ID NO: 11753 - DNA, 219 bp, Homo sapiens
  misc_feature 22: n = A,T,C or G
cttgccggatggttccataacngtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttc

SEQ ID NO: 11754 - DNA, 395 bp, Homo sapiens
  misc_feature 1, 11: n = A,T,C or G
ntgacacttcngacatcccacgcaaagcacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagg

SEQ ID NO: 11755 - DNA, 330 bp, Homo sapiens
  misc_feature 15: n = A,T,C or G
gaaactcctgcgggnctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagccca

SEQ ID NO: 11756 - DNA, 327 bp, Homo sapiens
  misc_feature 326: n = A,T,C or G
gcgaagatggcggagaacagcggtcgcgccggcaagagcagcgggagcggcgcggggaagggggcggtgtccgcagagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcattttttttctaccctgactcccacttctaatttctctttattggtattatna

SEQ ID NO: 11757 - DNA, 168 bp, Homo sapiens
gaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatt

SEQ ID NO: 11758 - DNA, 400 bp, Homo sapiens
  misc_feature 9, 23, 42, 67: n = A,T,C or G
atttttggnaaaaaaaccggagnttgcgcgcctgcaggtcgncactagtggatccaaagaattcggntcgagcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgt

SEQ ID NO: 11759 - DNA, 205 bp, Homo sapiens
  misc_feature 12: n = A,T,C or G
catgaatcctgnggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacctg

SEQ ID NO: 11760 - DNA, 333 bp, Homo sapiens
  misc_feature 1, 153: n = A,T,C or G
ntcggcacgagcggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggnagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggc

SEQ ID NO: 11761 - DNA, 336 bp, Homo sapiens
  misc_feature 19, 38, 56, 66: n = A,T,C or G
tgggaaaaaagaccggagnttgcgcgcctgcaggtcgncactagtggatccaaagnaattcggctngagataagaggcgcaaaagaaaagaatctcaaagtgaaaggaccagttcgaatgcctaccaagactttgagaatcactacgagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatg

SEQ ID NO: 11762 - DNA, 124 bp, Homo sapiens
aatgcttctaggcggactatgacttagttgcgttacaccctttcttgacaaaacctaacttgcgcagaaaacaagatgagattggcatggctttatttgttttttttgttttgttttggttttt

SEQ ID NO: 11763 - DNA, 200 bp, Homo sapiens
ccaaaattgacaccctaacatcacaattaaaagaactagaaaagcaagagcaaacacattcaaaagctagcagaaggcaagaaataactaaaatcagagcagaactgaaggaaatagacacacaaaaaaacccttcaaaaaattaatgaatccaggagctggttttttgaaaggatcaacaaaattgatagactgctaac

SEQ ID NO: 11764 - DNA, 183 bp, Homo sapiens
gcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatgg

SEQ ID NO: 11765 - DNA, 225 bp, Homo sapiens
atcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtg

SEQ ID NO: 11766 - DNA, 210 bp, Homo sapiens
  misc_feature 162: n = A,T,C or G
cttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgnactgttaatgggtttttttttaaaattaaaagattaaataaaaaatat

SEQ ID NO: 11767 - DNA, 130 bp, Homo sapiens
ctcagttcagtaccataactacagaacctgtcatctgtattttttgttctcaccccgtttttgttattttgtttctggttttttatattgaggtatgttttagatatagtttacaaaaataaaacgcaca

SEQ ID NO: 11768 - DNA, 388 bp, Homo sapiens
  misc_feature 25: n = A,T,C or G
tgcatcagcatttctgctgcccagnggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaaga

SEQ ID NO: 11769 - DNA, 299 bp, Homo sapiens
  misc_feature 20: n = A,T,C or G
cagagagaacccaccatggngctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtgga

SEQ ID NO: 11770 - DNA, 344 bp, Homo sapiens
caacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattga

SEQ ID NO: 11771 - DNA, 221 bp, Homo sapiens
  misc_feature 119: n = A,T,C or G
gcaggatcatctctcctcggtagtgcctgggcatcctggaacttatgcaaagaaagtccaacatggtgctgggtcttgtttagtaaacttgttacttggggttactttttttattttgngatatattttgttattccttgtgacatactttcttacatgtttccatttttaaatatgcctgtattttctatataaaaattatattaaatagatgctgctac

SEQ ID NO: 11772 - DNA, 230 bp, Homo sapiens
ctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctga

SEQ ID NO: 11773 - DNA, 236 bp, Homo sapiens
  misc_feature 218: n = A,T,C or G
gccgcgcggtgaggttgtctagtccacgctcggagccatgccgtccaagggcccgctgcagtctgtgcaggtcttcggacgcaagaagacagcgacagctgtggcgcacttgcaaacgcggcaatggtctcatcaaggtgaacgggcggcccctggagatgattgagccgcgcacgctacagtacaagctgctggagccagttctgcttctcggcaanggagcgatttgctggtgt

SEQ ID NO: 11774 - DNA, 340 bp, Homo sapiens
gctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagata

SEQ ID NO: 11775 - DNA, 189 bp, Homo sapiens
cagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttac

SEQ ID NO: 11776 - DNA, 298 bp, Homo sapiens
gttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttatta

SEQ ID NO: 11777 - DNA, 255 bp, Homo sapiens
  misc_feature 247: n = A,T,C or G
tgaaatcttagatcctgttgtaagtgaatgttttacttgataaataaaagactgccagtttggtgcagtggctcatgcctgtaatcccagcactttgggaggccaaagcaggcagactgcttgagtccaggagtttgagaccagcttggacaacatggtgaaaccccatctctacaaaaaatacaaaaattagttgggtgtggtggcccaggcctgtggtcccagctactcgggaagctgaggtggnaggatcat

SEQ ID NO: 11778 - DNA, 344 bp, Homo sapiens
gctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaag

SEQ ID NO: 11779 - DNA, 267 bp, Homo sapiens
  misc_feature 12, 98, 167: n = A,T,C or G
ctgtcttcactnctgggtgtctactgttataaactggagaatatgtgtggttaaatgccatgtttttcatttttaattgatctttttcttattgctgnggttctttgcctttttaggatttcttgtaaaaacctcaaaatggttataaagagtatcacagatgtggngttatggttagtgtgtactttgaaagtaatgaatgtttttatgtaattaaatatctttctgccaaaattacctacttagtgttatatttttaaactaatg

SEQ ID NO: 11780 - DNA, 288 bp, Homo sapiens
  misc_feature 117: n = A,T,C or G
tccagcctctcttaggaggggtaatggtggagttggcatcttgtaactctcctttctcctttcttcccctttctctgcccgcctttcccatcctgctgtagacttcttgattgtcangtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccacc

SEQ ID NO: 11781 - DNA, 176 bp, Homo sapiens
cgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaactta

SEQ ID NO: 11782 - DNA, 299 bp, Homo sapiens
ccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggccctgacatcacttaccaggagcctcaggga

SEQ ID NO: 11783 - DNA, 330 bp, Homo sapiens
gtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaac

SEQ ID NO: 11784 - DNA, 229 bp, Homo sapiens
ggcacttggttccatggagcctggataaacagtgctttggaggctctggacagctgtgtggtgtttgtgtcttaactatgcactgggcccttgtctgcgtcggcttgcatacagagggcccctggggtcggccctccggcctggcctcagccagtgggatggacagggccaggcaggcctctgaacttccacctcctggggcctcccagacctcctgtgcccccacctg

SEQ ID NO: 11785 - DNA, 317 bp, Homo sapiens
  misc_feature 138: n = A,T,C or G
ctcaccagacctcctaggcgacccagacaattataccctagccaaccccttaaacacccctccccacatcaagcccgaatgatatttcctattcgcctacacaattctccgatccgtccctaacaaactaggaggcgnccttgccctattactatccatcctcatcctagcaataatccccatcctccatatatccaaacaacaaagcataatatttcgcccactaagccaatcactttattgactcctagccgcagacctcctcattctaacctgaatcggaggacaaccagtaagctacccttttaccatcattg

SEQ ID NO: 11786 - DNA, 174 bp, Homo sapiens
  misc_feature 58, 59, 102, 112, 170: n = A,T,C or G
ggagctcgcgcgcctgcaggtcgacactagtggatccaaagaattgcgcgagacttanngcatttatggaaaaaatattaactatcctgaatattttataantttgtagganaaatatgcatctattttttcttgacttcttttatatagaaaaaaaagttattttggangaag

SEQ ID NO: 11787 - DNA, 327 bp, Homo sapiens
accaccatgtatccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagccctcacgaaactggaat

SEQ ID NO: 11788 - DNA, 264 bp, Homo sapiens
gcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccatt

SEQ ID NO: 11789 - DNA, 331 bp, Homo sapiens
  misc_feature 314: n = A,T,C or G
aataaaaataaagtatgaagcatcttggtgtgtagtttatgacccttatcatatttgctagagagttcccagatgtggagtttctgccttataatccttctcgatgttaagtcatccctctcctccgctcagtggtggctccttctaaaccacatctgcttttccagatgtgggctgggcacacagaagcagagcactgaagatatcgcctcctaaacttagaccagagcccttacctgccaccttcttagttccctttgctctagggcctgttacattcagcagtcaaggatttctcagacacaaagagcatnagggcttacaggatagc

SEQ ID NO: 11790 - DNA, 329 bp, Homo sapiens
agaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgc

SEQ ID NO: 11791 - DNA, 302 bp, Homo sapiens
cttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttg

SEQ ID NO: 11792 - DNA, 251 bp, Homo sapiens
  misc_feature 90, 141, 153, 223, 224, 239: n = A,T,C or G
ttcggcacgagcgcagcccagcctcgaaatgcagaacgacgccggcgagttcgtggacctgtacgtgccgcggaaatgctccgttagcantcgcatcatcggtgccaaggaccacgcatcccatccagatgaacgtggccngaggttgacaanggtcacaggcaggtttaatggccagttttaaaacttatgctatctgcggggccattcgtaggatggggtnnagtcagatgattccnttctcccgattg

SEQ ID NO: 11793 - DNA, 157 bp, Homo sapiens
  misc_feature 43, 44, 69, 70: n = A,T,C or G
gcgcgcctgcaggtcgccactagtggatccaaagaattcggcnncgagctgacacctcagggacaaagnnatctggacagaatcgccggacaggtggcagctgccaacaagaagcattagaacaaaccatgctgggttaataaattgcctcattcgt

SEQ ID NO: 11794 - DNA, 107 bp, Homo sapiens
  misc_feature 13: n = A,T,C or G
agtacttctagancggccgcgggcccatcgattttccacccgggtggggtaccaggtaagtgtacccaattcgccctatagtgagtcgtattacaattcactggccg

SEQ ID NO: 11795 - DNA, 311 bp, Homo sapiens
agagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgag

SEQ ID NO: 11796 - DNA, 121 bp, Homo sapiens
  misc_feature 120: n = A,T,C or G
ctcgtgccgagtacttctagagcggccgcgggcccatcgattttccacccgggtggggtaccagggtaagtgtacccaattcgccctatagtgagtcgtattacaatttcactggccgtna

SEQ ID NO: 11797 - DNA, 275 bp, Homo sapiens
gagaaggtccgtgccttgcccagaagtgtgtcttatcaccaagagatggcccggtgcactgagcacctactgtatgctagcactgcggtggccgtcctgctcagcggctcttggattagccatccttggctgcctgcaggggaggacgagtgttctcaccgttgtcctgctatggaggggaaggtgacaagcttctctggtggcacctgtgcctcaaagtgttgggaaagggtggttttcccaggtgggggcccctgccccgccccagcctcacc

SEQ ID NO: 11798 - DNA, 332 bp, Homo sapiens
atgagtgtggagcactcatgctgagcttagtgccatttttagaagagacatgagacagtttgcttcctctctctgctctccactaagtgaggagatggctatctgtaaaccaggaatggggttttcaccaagaacctggccatgctggcacactgatctcacacttccagcctccagaactgtgagaaataaatgttgtttaagccactctgtctatggtattctgatatagcggctggaactaactaaaacatactgtctacctcattgagttgttatacatactaaaggttgtaacactttagaaaaagccaagaaacacacacacacac

SEQ ID NO: 11799 - DNA, 342 bp, Homo sapiens
  misc_feature 26, 83, 199, 213: n = A,T,C or G
attcgttttcatatttctcatctggngtctagtctctttattgtattaactttcagcattaaaaagttgacaattcttaaagnggcccaagttcttcctttgatcatcattcatgtgtgtcatattacatttataactaaggccatgtgggatgagtgtgctattgccctgcaggagattaatctagggtcatcattgnggggttattatggncctatccactgttatatgtatcctcatccatcaggaccgtgctcttgttgttgcaggtaggctagcatgtcactgttcccggcaggtctcaaaacatgcagcagtgggttttgcagcagccctcagagg

SEQ ID NO: 11800 - DNA, 331 bp, Homo sapiens
ccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccag

SEQ ID NO: 11801 - DNA, 118 bp, Homo sapiens
gcatcatagtggtttcttaactctccaaaataagatttcttctctgtagcctacttgtctggtttatcccttacagaatattagtaagatttaatcaattaaaatatatatatatgcc

SEQ ID NO: 11802 - DNA, 137 bp, Homo sapiens
ttcggcacgagctttcttatttaattttggtctgcttatttttagataaaattgaaaggaattgtataaatcaattaacatattagctgagttgtccaacacatggtataaacgaattacaacagtaaactattaca

SEQ ID NO: 11803 - DNA, 334 bp, Homo sapiens
ggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaag

SEQ ID NO: 11804 - DNA, 395 bp, Homo sapiens
  misc_feature 19: n = A,T,C or G
ggaaaatgggcggaggacncttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagagg

SEQ ID NO: 11805 - DNA, 342 bp, Homo sapiens
  misc_feature 10: n = A,T,C or G
cagctttccnttccacaaatgaagtaactggtaactgtgacttattatgttatacagtgacagttattatgttatacagtgtcagttatacagtgacaaccaggacaaaatcctagggttctagattccccttctggtgctctttttaccagatgatggcattactaattgcctaccttgaggcctttgaaatcaccatgtctgataaaaacatgcaattgctttggtgaatttgtttgttttattggtggtgctttgagtgaatgcttcagtttgctctagattttactttgtttgttaaaaattaccatgttttaacccccgaaaacatttaatgttttt

SEQ ID NO: 11806 - DNA, 335 bp, Homo sapiens
  misc_feature 10, 171, 321: n = A,T,C or G
ctcaacctcntggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcanagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgnttaacaatacaatg

SEQ ID NO: 11807 - DNA, 258 bp, Homo sapiens
  misc_feature 17, 35: n = A,T,C or G
gcgcgcctgcaggtcgncactagtggatccaaagnaattcggctcgagggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtt

SEQ ID NO: 11808 - DNA, 329 bp, Homo sapiens
aagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagaga

SEQ ID NO: 11809 - DNA, 209 bp, Homo sapiens
caaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaaga

SEQ ID NO: 11810 - DNA, 264 bp, Homo sapiens
ctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccaga

SEQ ID NO: 11811 - DNA, 299 bp, Homo sapiens
taaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatatt

SEQ ID NO: 11812 - DNA, 336 bp, Homo sapiens
agcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaatta

SEQ ID NO: 11813 - DNA, 346 bp, Homo sapiens
  misc_feature 12, 166: n = A,T,C or G
gtcgcggcgacntggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgnggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgt

SEQ ID NO: 11814 - DNA, 112 bp, Homo sapiens
ctctgcattctaagaataatgtgggcggttcttatccttacattctggtggatacgtttacccctacttgacttcctgcagtaccacacttctgtcccctaacctgctgagg

SEQ ID NO: 11815 - DNA, 400 bp, Homo sapiens
  misc_feature 42: n = A,T,C or G
gcgcgcctgcaggtcgccactagtggatccaaagaattcggntcgaggcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcggggcagccggcgatgcccaat

SEQ ID NO: 11816 - DNA, 335 bp, Homo sapiens
ggacaccggggatctgcgacacctcagcctgccaaggagccgtgttaggaggggtcggggagaaatcaggctctagaagctcataaaattcaacgtgaggaagcaagtgacaaggacaagcaaagcacagtggacggtcatgaaggagcgggggtgtggcaaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtaggggtgtgtat

SEQ ID NO: 11817 - DNA, 342 bp, Homo sapiens
ttcggcacgagcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtacttttgtatctcagttaaagaagatgaaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcag

SEQ ID NO: 11818 - DNA, 325 bp, Homo sapiens
  misc_feature 176: n = A,T,C or G
gctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggngaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactgg

SEQ ID NO: 11819 - DNA, 342 bp, Homo sapiens
  misc_feature 165: n = A,T,C or G
gcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagnaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctg

SEQ ID NO: 11820 - DNA, 333 bp, Homo sapiens
  misc_feature 66, 276, 279: n = A,T,C or G
ttcggcacgagcaagaacagctggggcactgactggggtgagaagggttactactacttgcatcgngggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccntgnttccctgcacccaattccaccctgaagttctgcacctgcacctttgttgaattg

SEQ ID NO: 11821 - DNA, 399 bp, Homo sapiens
  misc_feature 12, 30, 38, 65: n = A,T,C or G
cctgcagggcgncactagtggatccaaagnaattcggnttgagaaagggcagggcacagcttggngtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatc

SEQ ID NO: 11822 - DNA, 333 bp, Homo sapiens
  misc_feature 154, 203, 317: n = A,T,C or G
cacaaaggaccattgtgttcagctgtttttgatcaacataatggcaaattgtatgactcaatagaataaaaaaagtgcttggaacaagtgccttggtattatatgcaatttgaagaatcaaggaaagagtcttcaaagaaaaaaaaaatatggncaagggaaggaaaggtaattaaaggaggaaatggctctaccttcagagngtctcacgtttcccgtcccctcgctggctgcctccctgccgcccagcagccccgtcctcagagcccatcttctttccactgtcaccaggcgcactgaggcttttgctgtaaggngtttgctgagcacgtg

SEQ ID NO: 11823 - DNA, 337 bp, Homo sapiens
gagcggcggcaggaggcgtagggccgggtcgcgcggggccaagtgtttggcacccgggtgtgacattgtgcagctcggacgctgtgtcggaatgagacaccggcttgtgtcattgtctgtgacatcatgtgtgactccggccgccggaacccgacgcggcagcgcgggtgctgttggcacaaacacaggcagagggggccctcctccccacgctctgcgtgcttccggcgagcaaagccccgcccaaggtgtctcctagctggggaaccagtaccggcccctggtgcactgtccagctctggagagataaaaggaagagctggtgccttccagtgga

SEQ ID NO: 11824 - DNA, 342 bp, Homo sapiens
caagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggccccgagaagacctcctttttccaggctttaggtatcaccactaaaatctccaggggca

SEQ ID NO: 11825 - DNA, 228 bp, Homo sapiens
cagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctcca

SEQ ID NO: 11826 - DNA, 340 bp, Homo sapiens
gggaaagggggtgggggccgcctagagcaggaggtattagtcactgcgcccaggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctaca

SEQ ID NO: 11827 - DNA, 162 bp, Homo sapiens
caaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattt

SEQ ID NO: 11828 - DNA, 378 bp, Homo sapiens
  misc_feature 5, 7, 122, 160, 161, 162: n = A,T,C or G
gaggncnaatgaatgactaataataatagtagcagtaatggtaaaaataataatattgagaatgtgcttcatgaagaggctcaggtccctgcactagagcatcagctttgcctgtaacttgnggggtaggtttgaggaggtctgttccctgctttggggnnnaattttcctatctttagcatagaagatgaaatgatgtgatctttaagtttatttccagatacatagagaatcatttgatttggacctttgagatagtatctccatttcacaagcagggaaattgaagcccaaaaaaatcaacctacatgccccaggctgcacagctagtagtggtagagtgcgaatgtaaaatccagattgatccagctcaaaggg

SEQ ID NO: 11829 - DNA, 232 bp, Homo sapiens
gctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttg

SEQ ID NO: 11830 - DNA, 400 bp, Homo sapiens
  misc_feature 4, 19, 57, 66, 90, 177: n = A,T,C or G
tggnaaaaaagcccggagntttgcgcgcctgcaggtcgccactagtggatccaaagnaattcggtncgagatcttttctaagttagcagntctcaaagtgcagttcctggactagcatcacctgagatctttttagaaatgcaaattcttgaatcctaccccagacctacttatcangaacctctggggttgggatccagaatctgtttagcgaggccctccagataagaaccaaccactgctctgggtgcttgatcacaggtttcacaagttgatatggtttagctgtgtccccacccaaatctcacttgacatgtaataatccccacatgtcaaggatgggaccaggtagagataattgaatcatgggggtggtttccctcatgctgttctcatggta

SEQ ID NO: 11831 - DNA, 136 bp, Homo sapiens
gagacaggtggtcctgtaaaagctttattcctaatgtgggcacattccactcccatgagtcttcaaaaactttttttttgaatatatttttttcagttgatacataatagaacaacgtttatgaacctgccgtttg

SEQ ID NO: 11832 - DNA, 309 bp, Homo sapiens
  misc_feature 15, 41: n = A,T,C or G
gcgcctgaaggtcgncactagtggatccaaagaattcggcntgagggaaagtccaagccgtaggacccagtttcctttcttagctgatgtctttggccagaacaccgtgggctgttacttgctttgagttggaagcggtttgatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgt

SEQ ID NO: 11833 - DNA, 296 bp, Homo sapiens
  misc_feature 4: n = A,T,C or G
tggnaaaaaagccggagcttgcgcgcctgcaggtcgacactagtggatccaaagaattcggctcgagccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagca

SEQ ID NO: 11834 - DNA, 400 bp, Homo sapiens
  misc_feature 19, 38: n = A,T,C or G
tgggaaaaaagaccggagnttgcgcgcctgcaggtcgncactagtggatccaaagaattcggctcgagagattttgttacaggatcacttgtaaacctgaggttactacagttagtaaaattttatgttcctaaaaaaacactcaatatatttctactaactaacaaatgatcgataactgtgactttctttttctcatcttactatcccctgatgtagcattcctaatacgccaaatctgtaacaccaatgaaggaaaattacacgaatatacctgtaattaaggaattgtccatgctcacaacagatttttttgtacatcccaaaacccaaatgtgacttaatgtttttgaataggtcacttttatattaaatatgtaaagggaaatatcagggttca

SEQ ID NO: 11835 - DNA, 397 bp, Homo sapiens
  misc_feature 4, 18, 37: n = A,T,C or G
tggnaaaaaagccggagnttgcgcgcctgcaggtcgncactagtggatccaaagaattcggctcgagcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaat

SEQ ID NO: 11836 - DNA, 334 bp, Homo sapiens
ggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtg

SEQ ID NO: 11837 - DNA, 328 bp, Homo sapiens
gaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaat

SEQ ID NO: 11838 - DNA, 336 bp, Homo sapiens
ctcgtgccgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttattt

SEQ ID NO: 11839 - DNA, 301 bp, Homo sapiens
agaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttgg

SEQ ID NO: 11840 - DNA, 342 bp, Homo sapiens
  misc_feature 14: n = A,T,C or G
aggcgaggcgccgngggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaa

SEQ ID NO: 11841 - DNA, 321 bp, Homo sapiens
  misc_feature 7, 163, 206, 216: n = A,T,C or G
ttcggcncgaggcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagngggaagatttataggtagaggcgacaaacctaccgagcctggngatagctggntgtccaagatagaatcttagttcaactttaaatttgcccacagaaccctctaaatccccttgtaaatttaactgttagtccaaagaggaacagctctttggacac

SEQ ID NO: 11842 - DNA, 400 bp, Homo sapiens
  misc_feature 6, 7, 58, 351: n = A,T,C or G
acattnnctggccgctagtggatccaaagaattcggctcgaggaagttctccagcttnagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgntactgtgatattttaaatatccacagtactcacttttttccaaatgatc

SEQ ID NO: 11843 - DNA, 331 bp, Homo sapiens
ctgatcgtatgcagaaggaaatcactgctctggctcctagcaccatgaagattaagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtg

SEQ ID NO: 11844 - DNA, 400 bp, Homo sapiens
  misc_feature 16, 44, 184, 353, 363: n = A,T,C or G
gtgcgcctgcaggtcnccactagtggatccaaagaattcggttngagggcatcaaggtagacaagggcgtggtccccctggcagggacaaatggcgagactaccacccaagggttggatgggctgtctgagcgctgtgcccagtacaagaaggacggagctgacttcgccaagtggcgttgtgngctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccganaaggtgctgnctgctgtctacaaggctctgagtgaccaccacatcta

SEQ ID NO: 11845 - DNA, 386 bp, Homo sapiens
  misc_feature 165, 168, 321: n = A,T,C or G
cggggtttcaccctgttggccaggctggtctcgaacagctgacctcaggtgatctgcccgccttggtctcccgaagtgctgggactacaggcgtgagccaccacgcccagccgagtctttgtgttttgaatgatctaacatttatcttgaaatatcttttatatngantgagcacttcccagacacaggagtgggaaagggaatatatgctggggaggccaaagcaactccatcttggatgccaatctgccgtgttggcttctcattaacccctgttccgaaaagtcctctaagatttccagtttatctgttgttccttgngtaaaaccaggtacttaccataaatcctacccttaggccaaataaccttgatattatcataattc

SEQ ID NO: 11846 - DNA, 341 bp, Homo sapiens
catcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctga

SEQ ID NO: 11847 - DNA, 181 bp, Homo sapiens
  misc_feature 82, 113, 153, 164: n = A,T,C or G
ttcggcacgagctgaaatgtttagcttactttaatcttgatatcagcctctacagaccttttattctaagctatcgagcttnttgattgcatttggttgaccacgagtgaccntaaggcattgggggactgtccacctgggagttggagtgancacgtggggcngcaacaggcattgtttt

SEQ ID NO: 11848 - DNA, 150 bp, Homo sapiens
  misc_feature 11, 32: n = A,T,C or G
aaagctggagnttgccgcttgaggtcgcactngtggatccaaagaattcggacgagcaactttctaacaaacatttattaatccagcctctgcctttcattaaatgtaaccttttgccttccaaattaaagaactccatgccactcctcc

SEQ ID NO: 11849 - DNA, 296 bp, Homo sapiens
gttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtac

SEQ ID NO: 11850 - DNA, 112 bp, Homo sapiens
  misc_feature 2: n = A,T,C or G
tnccaggtcagggctcggagggagctctgtgaagatgtgctttctttacagtggctgtaaaaagtttgtatttattatgtataaaatgttgaataataaaaaaaatggaatt

SEQ ID NO: 11851 - DNA, 114 bp, Homo sapiens
  misc_feature 12, 22, 28, 47, 54, 58, 67, 83, 95, 104: n = A,T,C or G
cttcatcccttnagtgcttagnaacagntaaagccatggatatgaangtgatanctgncattaatanccacattaaaattgcncttgattttagnttctccatnatcattttcc

SEQ ID NO: 11852 - DNA, 291 bp, Homo sapiens
  misc_feature 70, 159: n = A,T,C or G
tctcaaaaatgttcctttctctgaacttaacttaaagaagaaaaaggggaaaacttccactcctcgtggngttgagggagaactatcttttgtgacattggatgagattggggaagaggaagatgcagctgcacatctagcacaagctctagtcactgnggatgaagtaattgatgaagaagaactaaatatggaagaaatggtaaaaaattcaaattcactttttacattagatgaattaattgaccaagatgattgcatttcccacagtgaacctaaagatgttacctg

SEQ ID NO: 11853 - DNA, 356 bp, Homo sapiens
gaactgggcaggtggggataactaaattatctgcgtccctgactattcctggactacagctatatctcattgctgcccttcttcccaatccaaagcctcctttgcgtcctcctcttgtatccccccaccttaacccacaagtataagatacctctactccctccttggcgaccgatcatgcaccccgtacaatctctataaaacctaatcacccttaccccactcaacgccaatatcccatcccacagcacgctttaaaaatattaaagcctgttatcactcacctgctacagcatggccttttaaaacctataaactttccttacatttcccccattttacctgtcctaaaacca

SEQ ID NO: 11854 - DNA, 298 bp, Homo sapiens
  misc_feature 14, 40, 185, 297: n = A,T,C or G
cgccttcgaggtcnccactagtggatccaaagaaattcgnttcgagccaaagtggatgaggtgaagcccacaatcaagttccaaatgaagaaggtgttatgtctggctgtagctgttggtcaccgtgaagatgacagacgatgagcttgtgtataacaattcacctggctgtcaaccttcttggngtcattgctcaagaaaaactggcagaatgtccgggccttatatatcaagagcaccatgggcaagccccagcgccctatattaaggcacatttgaataaattctattaccagnt

SEQ ID NO: 11855 - DNA, 133 bp, Homo sapiens
actagtggatccaaagaattcggtcgagcctgggggctcctcaccacgtggggccatgctgagagctgggctttcctctgtgaccatcccggcctgtaacatatctgtaaatagtgagatggacttggggcct

SEQ ID NO: 11856 - DNA, 207 bp, Homo sapiens
  misc_feature 2, 75, 121, 131, 134, 169, 176, 179: n = A,T,C or G
gntttgcccccctttccctgccaccactccccttctccagaacattctgcttacccttcaagcttccactcttgncacttggggcttctgagaagagctctgaatccatccactctgcagncactgccagntgngcaccagcaaggactggtcctctcacctgctgggngtgcctngcnttcgggaggaggggctccctgtttgctg

SEQ ID NO: 11857 - DNA, 236 bp, Homo sapiens
  misc_feature 101, 166, 173: n = A,T,C or G
gtttcaggaaaaggggggcgggaggagagacaacagccgtgttccagagtctgtcctgagatgtcgctgagtccagacacttgggctgcaccgtgccctgnagatgacaaaggccggcagctcagcacacgtgcaggaggggttaaagccaatattgagtttttgntcttggnggtttaatctgaacgattattctcctgtaaaaataatttgggaggggcgggtgttgttcggtg

SEQ ID NO: 11858 - DNA, 314 bp, Homo sapiens
  misc_feature 10, 16, 41, 303: n = A,T,C or G
gcgcgcctgnaggtcnacactagtggatccaaagaattcgntacgaggcgagactgagaggcagaagtcagcccgaatgcctgtcagtttatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagnccgtatttctt

SEQ ID NO: 11859 - DNA, 298 bp, Homo sapiens
  misc_feature 150, 152, 217, 222: n = A,T,C or G
gcgcgcctgcaggtcgacactagtggatccaaagaattcggtcgaggggattcaaaccaacagtctgtcagtgtacagcagcagtactctcctgcacagtctcaagcaaccatatattatcaaggacagacatgtccaacagtctatggngngacatcaccttattcacagacaactccaccaattgtacagagttatgcccagccaagtcttcagnatatncaggggcaacagattttcacagctcatccacaaggagtggggggacagccagccgcagcagtgactacaatagttg

SEQ ID NO: 11860 - DNA, 100 bp, Homo sapiens
  misc_feature 14, 38, 40, 60, 66, 69, 96: n = A,T,C or G
aagctgaatccttncatttcttctgcacatctacttgntnaaattgggggcaaaagaganaaaganggntggatcggagcattgtgcaatacagtntcat

SEQ ID NO: 11861 - DNA, 106 bp, Homo sapiens
  misc_feature 8, 11, 28, 32, 42, 53, 57, 64, 69, 75, 91: n = A,T,C or G
ataggcgnctnggggtcaaaaagctcangatnagattccagnactgtccgtgncccngccccanaccgntctggncttcctgggccctgancctgaggacctggag

SEQ ID NO: 11862 - DNA, 255 bp, Homo sapiens
  misc_feature 179, 183: n = A,T,C or G
cagaaaccacccaccttcaccatgtctgacgaggaagttgaacaggtggaggagcagtacgaagaagaagaggaagcccaggaggaagaggaagttcaagaagacaccgcagaggaggacgcggaagaggagaaaccgagacccaaactcactgctcctaagatcccagaagggggggnaagnggacttcgatgacatccagaagaagcgtcagaacaaagacctaatggagctccaggccctcatcgacagcca

SEQ ID NO: 11863 - DNA, 120 bp, Homo sapiens
  misc_feature 18, 44, 79, 87: n = A,T,C or G
gcgcgccctgcaggtcgncactagtggatccaaagaaattcggntcgagctcgtgccgaattcggacgagcactacttntacacggntgacttcaagaccatcaaccagataggcaagaa

SEQ ID NO: 11864 - DNA, 310 bp, Homo sapiens
ccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaac

SEQ ID NO: 11865 - DNA, 351 bp, Homo sapiens
  misc_feature 85, 170, 269: n = A,T,C or G
gtcaaattgtgtcctccatcactgcttccctgagatttgatggagccctgaatgttgacctgacagaattccagaccaacctggngccctatccccgcatccacttccctctggccacatatgcccctgtcatctctgctgagaaagcctaccatgaacagctttctgtngcagagatcaccaatgcttgctttgagccagccaaccagatggtgaaatgtgaccctcgccatggtaaatacatggcttgctgcctgttgtaccgtggngacgtggttcccaaagatgtcaatgctgccattgccaccatcaagaccaagcgtaccatccagtttgtggattggtgcccca

SEQ ID NO: 11866 - DNA, 338 bp, Homo sapiens
  misc_feature 35: n = A,T,C or G
gcgcgcctgcaggtcgacactagtggatccaaagnaattcggctcgagtgaagcccgacacggcctgagcgtccagaaatggtgctcaccatgcttccagctaacaggtctagaaaaccagcttgcgaataacagtccccgtggccatccctgtgagggtgaccgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaattt

SEQ ID NO: 11867 - DNA, 398 bp, Homo sapiens
  misc_feature 13, 16, 68, 151, 221, 310, 316, 379: n = A,T,C or G
gcgcgcctgcagntcnccactagtggatccaaagaattcggttcgagaaattctctcatgatgctganccagaagtttcctataactccatttttgccatgggcatggtgggcagtggtaccaataatgcccgtctggctgcaatgctgcnccagttagctcaatatcatgccaaggacccaaacaacctcttcatggtgcgcttggcacagggcctgacncatttagggaagggcacccttaccctctgcccctaccacagcgaccggcagcttatgagccaggtggccggggctggactgctcactgngcttgnctctttcctggatgttcgaaacattattctaggcaaatcacactatgtattgtatgggctggnggctgccatgcagcccccg

SEQ ID NO: 11868 - DNA, 216 bp, Homo sapiens
  misc_feature 16, 26, 32, 58: n = A,T,C or G
aaaaagcctggagttngcgcgcctgnaggtcnacactagtggatccaaagaattcggncgagtacaaagaaaattaaggcaccgagaagttacattatgtgcccaaatcacacagatagaaagttatggaatcagaagtcaaactcaagcagagctgtgccagaatttgtactcttaacttatattatctctaaataaatgctgctgttaagttgt

SEQ ID NO: 11869 - DNA, 166 bp, Homo sapiens
  misc_feature 73: n = A,T,C or G
gcgcgcctgaggtcgccactagtggatccaaagaattcggtcgagaaaattatatatatatatattaaaaagnctctattcttcaccccccagccttcctgaacctgcctctctgaggataaagcaattcattttctcccaccctcggccctcttgtttttaaaat

SEQ ID NO: 11870 - DNA, 400 bp, Homo sapiens
  misc_feature 15: n = A,T,C or G
gcgcgcctgaggacnccactagtggatccaaagaattcggtcgaggatccacctgcctccgccctcccaaagtgctgggattataggtgagatccaccgtaccctgccattttgttttgtttgaagagactctcgctctgttacccagcctggagcgcagtggcacagtcatgctcactgcagcctcgacctcccaggctcaggcggtccttctgcctcagcctcccaagtagctgggactgcagatgcacactaccatgtgcccagctaattttttgtagagacgctgtcttaccatgttgcccaggctgttcttgaactcctcagctcaaagcagtccacctgccttggcctcccagagtgctgggatcacaggcatctcattgtattttttactgcc

SEQ ID NO: 11871 - DNA, 399 bp, Homo sapiens
  misc_feature 179, 325: n = A,T,C or G
gcgcgcctgaaggtcgccactagtggatccaaagaattcggtcgagctgaatggctgacctgacctgatgtccattcatcccaccctctcacagtttggacttttctcccctctctttctaagagacctgaactgggcagactgcaaaataaaatctcggggttctatttatttattgncttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggngctattctgtgtcaaacacctctgtattttttaaaacatcaattgatattaaaaatgaaaagattattggaaag

SEQ ID NO: 11872 - DNA, 278 bp, Homo sapiens
  misc_feature 17, 42, 44, 223, 225, 227: n = A,T,C or G
gcgcgcctgcaggtcgncactagtggatccaaagaattcggntngagccagtttgatgctaaaaagtttgcagagacccaacctaaaaaggacacaccacggaaagagaagggttcaccgggaagagaagcagaagccccaggctgagcggaaggaggagaaaaaggcggctgcccctgctcctgaggaggagatggatgaatgtgagcaggcgctggctggngngnccaaggccaaggaccccttcgctcacctgccccaagagtacctttgtgttg

SEQ ID NO: 11873 - DNA, 398 bp, Homo sapiens
  misc_feature 1, 4, 29, 69, 214, 272, 275: n = A,T,C or G
ntcnccactagtggatccaaagaattcgnttcgagccagaacatcatccctgcctctactggcgctgcnaaggctgtgggcaaggtcatccctgagctgaacgggaagctcactggcatggccttccgtgtccccactgccaacgtgtcaagtggtggacctgacctgccgtctagaaaaacctgccaaatatgatgacatcaaagaagggggngaagcaggcgtcggagggccccctcaagggcatcctgggctacacttgagcaccaggnggnctcctctgacttcaacagcgacacccactcctccacctttgacgctggggctggatttgccctcaacgaccactttgtcaagctcatttcctggatgacaacgaatttggctacagcaacagg

SEQ ID NO: 11874 - DNA, 392 bp, Homo sapiens
  misc_feature 8, 35, 37, 218, 252, 255, 338: n = A,T,C or G
ggaacaanaagcccggagtttgggcgcctgcaggncnccactagtggatccaaagaattcggttcgagcaaagcctaaatcttcataatggcctacgggacctccatgatctgatacccaccctacccacctctctcccccttcctctgataatgtcacctcttacttgctctctccagcttgctcactctttaaaactacttcatattccttgctgntcctcaaacataacaaagcacactttacatttgntgnttcctaggcataaatgaccactgcccccttactggatatcatcatagatttctccctcacttcttgcatttctgatgaaaagngatttttccagttagaacttccctgcctgccttaaaatgctccatttttgtttt

SEQ ID NO: 11875 - DNA, 278 bp, Homo sapiens
  misc_feature 42: n = A,T,C or G
gcgcgcctgcaggtcgccactagtggatccaaagaattcggntcgagaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtt

SEQ ID NO: 11876 - DNA, 400 bp, Homo sapiens
  misc_feature 29, 35, 192, 195, 371: n = A,T,C or G
tgggacaaaagccggagttgcgcgcctgnggtcgncactagtggatccaaagaattcggctcgagcacttacactgttcttgtagatggctgctctaaaaagacaaatgaatggggaaagacaatcattgaatacaaaacaaataagccatcacgcctgcccttccttgatattgcacctttggacatcggnggngctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgngggcaaaagagaaaaagaaggattgatca

SEQ ID NO: 11877 - DNA, 367 bp, Homo sapiens
  misc_feature 16, 60, 69, 107, 193, 196, 209, 234: n = A,T,C or G
tgcgcgcctgcggtcnccactagtggatccaaagaattcggtcgagctcgtgccgaattngggcggggngatgtagaaagttgtaaaatagaaaaagtggagttggngaatcgggtgttctttcctcacatttggatgattgtcataaggtttttagcatgttcctccttttcttcaccctcccctttttttnttntattaatcaaganaaacttcaaagggtaatgggatggncggatctcacaggctgagaactcgttcacctccaagcatttcatgaaaaagctgcttcttattaatcatacaaactctcaccatgatgggaagagtttcacaaatcttttcaaaataaaaaggaatgacttag

SEQ ID NO: 11878 - DNA, 351 bp, Homo sapiens
  misc_feature 14, 173, 174: n = A,T,C or G
ctcgtgccgcaatngtggagccaaaatggaatctatgggcatacccagactgtgataggtacttattgcctggtataaagagagcaattaatgaatactgtttaatgaatgaacaaagaaatgaatggggcaggcagaggccaaatactgtgtatgctttcctatgtactcanngtgatttgaacaaatttcctaacaccctgtgtttttggacaccttgatcgggaacttcagaaggcaaacagccgagcaagagcaagcctggtacagtatgtcagcattccagattgactgcagctgggctgaaatgcaaggggaggacaaagaggctgcactagaaggcaaggggag

SEQ ID NO: 11879 - DNA, 399 bp, Homo sapiens
  misc_feature 42: n = A,T,C or G
gcgcgcctgaggtccgacactagtggatccaaagaattcgtnacgagatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggc

SEQ ID NO: 11880 - DNA, 398 bp, Homo sapiens
  misc_feature 9, 15, 39, 40, 41, 42, 61, 63, 220, 221: n = A,T,C or G
cgcgcctgnaggtcnacactagtggatccaaagaaattnnnnacgagctcattcttcaaangngggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgnnaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaaca

SEQ ID NO: 11881 - DNA, 400 bp, Homo sapiens
  misc_feature 27, 46, 51, 53, 54, 73, 77, 305: n = A,T,C or G
tggttttggggcgccttcgaaggtccnacactagtggatccaaagnaattntnnacgagattggtttacctgngaancagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagntgtgtttgatatccaaagctgaatacattctgctttcatcttggcacatacaattatttttacagttctcccaagggagttaggctattcacaac

SEQ ID NO: 11882 - DNA, 396 bp, Homo sapiens
  misc_feature 43, 45, 63, 223, 224: n = A,T,C or G
tgcgcgcctgcaggtcgccactagtggatccaaagaattcggntngaggcctacggaggtggnagccatctccttctcggcatcatggccgccctcagaccccttgtgaagcccaagatcgtcaaaaagagaaccaagaagttcatccggcaccagtcagaccgatatgtcaaaattaagcgtaacttggcggaaacccagaggcattgacaacagggttcgnngaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttc

SEQ ID NO: 11883 - DNA, 220 bp, Homo sapiens
  misc_feature 10, 19, 109, 162, 164, 167, 203, 216: n = A,T,C or G
ttcggcacgnggcggcggngaagatggttacgtccgatccattacttcgacccacagtacttcgaatttgagtttgaggcttaagaagctggatctcctgccgggcggngggggctcatgcctgtaatcccaccacttttttttttaaggcaggcgggatcncntgnggtcagggagtttaagaccagcctgaccaacatggngaaacctggtctntact

SEQ ID NO: 11884 - DNA, 398 bp, Homo sapiens
  misc_feature 17, 70, 220, 221, 222: n = A,T,C or G
tgcgcgcctgcaggtcnccactagtggatccaaagaattcggtcgagttcaacttaagatcatgggaagncatggaaaagttgagtcctgcaggtttgtttgttttttgttttggcttttaggggaaggaggtgaattaccagatttccatttcataaagagggtggaaaagagtcacagtgagtatgaatagcaactgcagtcacccaggtgactgggnnnggagggtggatttgagatactttttggaggcagaatcaacagaaacttggtttgggaaagaatacaggggatgacagcatggaagaccaagattcagctctgattgaagtgcttcagatacattcaattagaaactccacaaggcaacaggaccaaccagcgttggagaccttggg

SEQ ID NO: 11885 - DNA, 342 bp, Homo sapiens
  misc_feature 281: n = A,T,C or G
gcttactatgcctccaaaggctaccgtggttactcctatgatgacattccagactttgatgactagcacccaccccatagctgaggaggagtcacagtggaactgtcccagctttaagatatctagcagaaactatagctgaggactaaggaattctgcagcttggggatgtttaagaaaataatggccagattttttgggtccttcccaaagatgttaagtgaacctacagttagctaattaggacaagctctatttttcatccctgggccctgacaagnttttccacaggaatatgtatcatggaagaatagaggttattctgtaatggaaaagtgttgc

SEQ ID NO: 11886 - DNA, 399 bp, Homo sapiens
  misc_feature 16, 35, 44, 191, 220, 277, 306: n = A,T,C or G
gcgcgcctgcaggtcnacactagtggatccaaagnaattcggtncgagatccagcatgagccccacgaccaacgtgctcctgtctcctctcagtgtggccacggccctctcggccctctcgctgggagcggagcagcgaacagaatccatcattcaccgggctctctactatgacttgatcagcagcccanacatccatggtacctataaggagctcctngacacggtcactgccccccagaagaacctcaagagtgcctcccggatcgtctttganaagaagctgcgcataaaatccagctttgnggcaccttctggaaaagtcatatgggaccaggcccagagtcctgacggggcaacccttcgcttggacctgcaagaagatcaacaactggggtg

SEQ ID NO: 11887 - DNA, 400 bp, Homo sapiens
  misc_feature 61, 218, 219, 221, 277, 363: n = A,T,C or G
tgggcgcctgaggtccacactagtggatccaaagattcggttcgagatccctcatagaccntaattagatttatttaacatacagaagaatctaaagcttttgtctactcactagttttacttccttttaattttacatgaaaaaaaatctcaagttcattatagatgtaggtgacaaaagagggatagcatttggaaattacatttgttccagactnngnaaggcacatgtgatctaagacctttgggcttggcaaagtgagagctatcaaatggnggggacatggaaaagggccatccttgctgacagttgtatttctgagttacaatactgcctccttccttactgtcaaagtatgctgnggatatggagctgttttaatgctccaaaaaggtaaga

SEQ ID NO: 11888 - DNA, 400 bp, Homo sapiens
  misc_feature 18, 37, 45, 220, 224, 226: n = A,T,C or G
cgcgcgcctgcaggtccnacactagtggatccaaagnaattcgtnacgagccacgatgcccagcctgtacatgtcaacttagtcttaaggaatgttgtttgaattctgttttgaatcatgcatatactgtcttcaatttgggcaactgaggagaaacaaagtataggctttctgattacaggaaaatctctcacatagagactttttagttgtcatgggngggngnagatacaatggaaaataatcttactaacttgatattagaaggtagaaaaatgtcattatcttggaaatctcactttatgaggtggcccgaaaaaagtttttatttccctatattcatgctatattgcatgtttgttacattgataaatatgctaataacctttcttgcttgttt

SEQ ID NO: 11889 - DNA, 306 bp, Homo sapiens
  misc_feature 17, 43: n = A,T,C or G
tgcgcgcctgcaggtcnccactagtggatccaaagaaattcgnttcgagcgtgtgttcaacgactgccgggacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaagg

SEQ ID NO: 11890 - DNA, 399 bp, Homo sapiens
  misc_feature 17, 42, 131, 148, 222: n = A,T,C or G
gcgcgcctgcaggtccncactagtggatccaaagaattcgtncgagaacaaaattaaaaagaaaaaaaaatacctgagactgagtaacttataaagaaaagaggtttaattgactcacagttctgcagggngtacaagaaagcatggngccagcatttgctcggattctggggagacctgagggagcttttactcatggcagaaggtgaagggggagccggngtctcacatggcaaagcaggagcaagagagagtggtagggaggtgccacatacttttaaacagccagatctctcaagaactcactcactgtcaccaggacagcaccaagccatgagggatccaccctcatgacccagttacctcccggcagggcccaccttccggcactaggaatta

SEQ ID NO: 11891 - DNA, 163 bp, Homo sapiens
  misc_feature 60: n = A,T,C or G
aaaaaacaaagctacttactttttgttttttattttaagttatttttggccaggcatggngatttatgcctgtaatcccagcactttgggaggccaaggcaggaggatctcttgagtctgggagtttgagaccagcctggacaacatagtgagaccctcgtct

SEQ ID NO: 11892 - DNA, 266 bp, Homo sapiens
  misc_feature 17, 43, 191, 260: n = A,T,C or G
gcgcgcctgcaggtccncactagtggatccaaagaattcgttncgagcgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacgggatggngtgaagcactccatgaaccccttctgtgagatcgcggtggaggaggcctgtgccgcctcaagggagaanaagctg

SEQ ID NO: 11893 - DNA, 398 bp, Homo sapiens
  misc_feature 7, 21: n = A,T,C or G
attttgngcgcctgaaggtcnccactagtggatccaaagaattcgtttcgaggacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgggtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggc

SEQ ID NO: 11894 - DNA, 398 bp, Homo sapiens
  misc_feature 3, 40, 42, 67, 371, 397: n = A,T,C or G
tgngcgcctgaggtcccactagtggatccaaagaattcgntncgagctataccgtatgacctagggnggggagtaggctgtaccatccaggtttctataagtaacactctgcgatgttcacaccaggacaaaatcacctaatgacgcgcttctcagaatatatccccattgttaaatgacacatggctgtagttattagaattaattgatgctctttagcctagattctcaaattgtatgttggtaaggactgtttttcccacatgttgagaatggatacttttgaaaaacataataacattgttgcagtttctcaagaactaccctccatatctgtacttttcttgggctggcaagaaatagttcatggncagtctttaaagaatattactacagng

SEQ ID NO: 11895 - DNA, 397 bp, Homo sapiens
  misc_feature 27, 132: n = A,T,C or G
aaacctggtttcgggcgcctgaggtcnacactagtggatccaaagaattcttacgagtaacagccaagatgctgcggaatctgctggctcttcgtcagattgggcagaggacgataagcactgcttcccgcnggcattttaaaaataaagttccggagaagcaaaaactgttccaggaggatgatgaaattccactgtatctaaagggtggggtagcttgatgccctcctgtatagagccaccatgattcttacagttggtggaacagcatatgccatatatgagctggctgtggcttcatttcccaagaagcaggagtgacttcagtcatcccagcaattgcttggttcagtttcattcagctctctatggaccagtaatctgataaataaccgag

SEQ ID NO: 11896 - DNA, 162 bp, Homo sapiens
  misc_feature 43, 121: n = A,T,C or G
tgcgcgcctgaaggtcgccactagtggatccaaagaattcggntcgagggagatgatgtgaaagtagaacgaatcgaatacaaaaaaccttaaagccaggcctgtcttgatgatttttggntttttttcattgtcctgttgaaatcaagtaattaaacattt

SEQ ID NO: 11897 - DNA, 397 bp, Homo sapiens
  misc_feature 1, 14, 58, 59, 177: n = A,T,C or G
nggaaaaaaccggnttttgcgcgcctgaggtccacactagtggatccaaagaattcgnncgaggcttgcccaccctctccgggatcccagagcaagtggcgggtatctcgtcgaaaagcgcccgtctccatccgatgcctttccaagctggcggtgctcaggggcatggtgccattnctgggggtggccgaggttgcaaggggtgcccatgcttggtgtcccacctctctagttctaggctcctcccccaaccctactaggggcttgtccctggtctgggacaggcttggaaagtgtggcgcgagtatggctgaggcgtggttgtttgagggtgtgacccttgcagtccctgtcccagggataggggtggcccgtgtggcccaggggtggccgaaag

SEQ ID NO: 11898 - DNA, 325 bp, Homo sapiens
  misc_feature 59, 61, 268, 298, 310, 317: n = A,T,C or G
ggaaaaaaaccggatttttgcgcgcctgcaggtcccactagtggatccaaagaattcgntncgagtttagttcgagtcccttttgtggagaaagggagatgaaaactgaccacgtgccaggtgtggccgaagcccccagggagggccacattcggggagcggggggtccgggggagggccaccgactggctctgctgccagcacaggcccctccctggaagtcctcgggagcggagcgggggatcggcacggcctctgggctccccgnggagagaagctgtagtttttaccaaattgngacatctgggcngatgttnaatttctg

SEQ ID NO: 11899 - DNA, 365 bp, Homo sapiens
  misc_feature 1, 32, 38, 304: n = A,T,C or G
nggaaaaaaaagccggagttttgcgcgcctgnaggtcnacactagtggatccaaagaattcggtacgagtggctttctctccagcctctcttaggaggggtaatggtggagttggcatcttgtaactctcctttctcctttcttcccctttctctgcccgcctttcccatcctgctgtagacttcttgattgtcaagtctgtgtcacatccagtgattgttttggtttctgttccctttctgactgcccaaggggctcagaaccccagcaatcccttcctttcactaccttcttttttgggggnagttggaagggactgaaattgtggggggaaggtaggaggcacatcaataaagaggaaacca

SEQ ID NO: 11900 - DNA, 398 bp, Homo sapiens
  misc_feature 64, 66: n = A,T,C or G
ctcttgggaaaaaacccggattttgcgcgcctgcaggtcccactagtggatccaaagaattcgntncgagacgcctcggtgtatcctaccacgcgtttctgcttgtgttcgggagggtcaccccgcattatttagaacgttaagaattttgtcaaaagtctagtttctcggggatttgcggactttcaccagttttacgactaagttttgtcttggatagagggcattaaatgtgctttacccaatcttgaggatggcccgttttaaggcaagtaagtaattgaaacttgggccagattttgcataacgtgcattcttctatttgcgtttttaaacagaaaccaaggtgtatgttggtaacctgggaactggcgctggcaaaggagagttagaaaggg

SEQ ID NO: 11901 - DNA, 396 bp, Homo sapiens
  misc_feature 21, 173, 226, 232, 287, 367, 376, 383: n = A,T,C or G
atggcccggggccggaagccncacttaaagcgtgttgagcgccgaagcattggatgcttgacaaactaacgggtgtatttgcacctcgtccatcgacaggtccccacaagctgagggaatgtcttcctctgatcgtcttcctcaggaatagactcaagtatgcgttgactggngatgaggtaaagaagatatgtatgcaacgtttcatcaaaattgatggcaaggntcgagnggatgtcacataccctgctggattcatggatgtcatcagcatcgagaagacaggngaacattttccgcctggtctatgacaccaagggccggtttgctggtcaccgcatcacaggggaagaggcaaagtacaagntgggcaagngaggaanatactgggggagg

SEQ ID NO: 11902 - DNA, 142 bp, Homo sapiens
  misc_feature 15, 21, 140: n = A,T,C or G
tatagtctctcaagntcacangaaatgttgattttctaaggtcctcatttttacagagtatacaggcaaagtgacaggggaaaaggaattagtctaagagtaaggggatgattattatattgaggctaaaaccacaaagngg

SEQ ID NO: 11903 - DNA, 248 bp, Homo sapiens
  misc_feature 4, 152: n = A,T,C or G
atcngccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaaggncgccatcagaagactgaaggagttgaaagaccagtagacgctcctctactctttgagacatcactggcctataataaatgggttaatttatgtaac

SEQ ID NO: 11904 - DNA, 171 bp, Homo sapiens
  misc_feature 20: n = A,T,C or G
cttttgtaaagttgcctggnatgtcatttgttaggttataaacacaagatctaaatgaagggttttatgtgttgtgtacaaaatcttattttgaaatggacaaacttgtcattacatttgtaaccttgtacagaggatttttcactatgtgcctagcttggtgtccattca

SEQ ID NO: 11905 - DNA, 148 bp, Homo sapiens
  misc_feature 37, 71: n = A,T,C or G
tgggcgcttcgcaggtcgccactagtggatccaaagnaattcggttcgaggaaagatgagaagaaggaggngtctgaagagtcacgatgatgacatgggatttggcctttttgattaaattcctgctcccctgcaaataaagcctttt

SEQ ID NO: 11906 - DNA, 385 bp, Homo sapiens
  misc_feature 10, 12, 31, 38, 41, 45, 61, 276: n = A,T,C or G
cgcctgaggncnccactagtggatccaaagnaattcgnttngagnagaagaccctcgaggnttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagntgatcaacctattaaaatgtgtatttcattgggtagcttttctcactgtagacagattttttccttcttcaatgaaaaggcttttaaattagtacaactgttactattt

SEQ ID NO: 11907 - DNA, 183 bp, Homo sapiens
  misc_feature 3, 37, 46, 57: n = A,T,C or G
tgngcgcttcgcaggtcgccactagtggatccaaagnaattcggtncgaggcaaggnacacttacagcgagttttactttcggttgtattttctttgtatattataaacatttatttaacttgttgccgtttgaagtaaaaaatttccaaaatgtatgctcaacaataatcattaaaatgttt

SEQ ID NO: 11908 - DNA, 400 bp, Homo sapiens
  misc_feature 14, 18, 42, 222, 377: n = A,T,C or G
tgcgcgcctgcagntccncactagtggatccaaagaattcgnttcgagggagaattaggaccagggggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggngaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgngcagggagaacagggtgccaccg

SEQ ID NO: 11909 - DNA, 398 bp, Homo sapiens
  misc_feature 3, 15, 222, 224: n = A,T,C or G
tgngcgcctgcaggnccacactagtggatccaaagattcggttcgaggtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggangncgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgttt

SEQ ID NO: 11910 - DNA, 131 bp, Homo sapiens
  misc_feature 3, 11, 30, 37, 65: n = A,T,C or G
ccntgcagtgnccactagtggatccaaagnaattcgnttcgagaaaaatagagagacaagaaggnaagtagaaagagaagaaggaagagaaggaaaggtgaaaataagaagggaaagaaagaagtcccaag

SEQ ID NO: 11911 - DNA, 398 bp, Homo sapiens
  misc_feature 41, 43: n = A,T,C or G
tgcgcgcctgcaggtcccactagtggatccaaagaattcgntncgagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaag

SEQ ID NO: 11912 - DNA, 108 bp, Homo sapiens
cactagtggatccaaagaattcggttcgaggacaaaacctaacttgcgcagaaaacaagatgagattggcatggctttatttgttttttttgttttgttttggttttt

SEQ ID NO: 11913 - DNA, 187 bp, Homo sapiens
  misc_feature 9, 12, 37, 38: n = A,T,C or G
cgcttgagntcnccactagtggatccaaagaattcgnncgagccccatctcagaacagaagggtgggaagccagagccgcctgccatgcccagccagtccccacagcataacagggtctccttggcagctgtattctggagtctggatgttgctctctaaagacctttaataaaattttgtacaaag

SEQ ID NO: 11914 - DNA, 396 bp, Homo sapiens
  misc_feature 1, 18, 44: n = A,T,C or G
ngcgcgcctgcaggtccncactagtggatccaaagaaattcgtncgagtgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaacctttaagttactccccaaacgtttgctggccacattctcatttctaaacatctggatctg

SEQ ID NO: 11915 - DNA, 397 bp, Homo sapiens
  misc_feature 40, 42, 220: n = A,T,C or G
gcgcgcctgcaggtcccactagtggatccaaagaattcgntncgagggcctcagctcctgaagctctgaatttacagtacacagtagcagacggcttgccctttggaaggctccatggaaagaaggctcatccctgacttggggcaaccttgaccgaagtttctactctccagaatctcttttctgtggtcacccgactggcaagtggaagatggaagcnccaaggttcctgcaaaagatagatcaagacctttgctatcaacctttcagcccatcccaatggccttgaatggcacgtgtcctggaaaaccaggtctgctgcctgtacgcccgagcgaaacctatgctcagctggagaagaggacagcctttcagggttcatgaatgttctccctag

SEQ ID NO: 11916 - DNA, 375 bp, Homo sapiens
  misc_feature 172, 176, 191: n = A,T,C or G
cttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagcccgaaaganccgnggccgcacctgccgngacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaaga

SEQ ID NO: 11917 - DNA, 326 bp, Homo sapiens
  misc_feature 123, 166, 236: n = A,T,C or G
ttcggcacgagtgaatatatcacaatttgtttattcattcgtctattggttgacattttggttgtttttggtttttggctattgcaaataaaactattaatttgtgcatacaagtctttgggngggtctatgctttcttttctggtaaacacctattaatagaagnggaatgaccgggtcacatgtcaggtatatatttaattttttagtaaattgttttccaagccaggcacagnggctcatgcctgtaatcccagaactttgggaggctgaggtaggaggaacacttgaggccagaagtccaagaccagcctaggcactatagc

SEQ ID NO: 11918 - DNA, 394 bp, Homo sapiens
  misc_feature 4, 9, 36: n = A,T,C or G
gggnacaanaagcccggagtttgcgcgcctgcaggnccccactagtggatccaaagaattcggttcgagaagactctctaaagaaaatctattaaaatgtacagaattttacatgtatgtgggagtacccataggaaaatgaagacccaaaaagcagttagagctgaatgtttacatactaaattggacgagtagtaaattgtgaaaacctgacaaaacacagggacatgggctaggatatttaattacggagaagtgactagagatattgagggttagtttaccaaggttgctttgtgcagattttccttggcttagactccccatctttggtgataagagtatccttcttcctcctgatatagggatactatcttttacatgggagtttcat

SEQ ID NO: 11919 - DNA, 399 bp, Homo sapiens
  misc_feature 35, 42, 44: n = A,T,C or G
gcgcgcctgcaggtccacactagtggatccaaagnaattcgntncgagccgccaaacagctactcagctgcttaagctggcccacaagtacagaccagagacaaagcaagagaagaagcagagactgttggcccgggccgagaagaaggctgctggcaaaggggacgtcccaacaaagagaccacctgtccttcgagcaggagttaacaccgtcaccaccttgggggagaacaagaaagctcagctggtggtgattgcacacgacgtggatcccatcgagctggttgtcttcttgcctgccctgtgtcgtaaaatgggggtccctttactgcattatcaagggaaaggcaagactgggacgtctagtccacaggaagacctgcaccactgtcgccttca

SEQ ID NO: 11920 - DNA, 364 bp, Homo sapiens
  misc_feature 7, 10, 51, 53, 256, 356: n = A,T,C or G
cctgganttngcgcgcctgcaggtccacactagtggatccaaaaaattcgntncgagctcgtgccggtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgngcctttccctgtgtgaattttgtatctagcctaaagtttccctaggctttcttgtctcagcaactttcccatcttgtctctcttggatgatgtttgccgncagcattc

SEQ ID NO: 11921 - DNA, 339 bp, Homo sapiens
  misc_feature 161, 162, 170, 317: n = A,T,C or G
gtcgaagtggctctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggnnatgatggnggttatggaggaggcggccctggttactctggaggaagcagaggctatggaagtggtggacagggttatggaaaccagggcagtggctatggcgggagtggcagctatgacagctataacaacggaggcggaggcggctttggcggnggtagtggaagcaattttggag

SEQ ID NO: 11922 - DNA, 335 bp, Homo sapiens
cagaaatggcacctcgaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctg

SEQ ID NO: 11923 - DNA, 269 bp, Homo sapiens
ttcggcacgagggcccgtatcttgggcatggtgtgaaatcacttcatatatcatgtgctgtaaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttg

SEQ ID NO: 11924 - DNA, 357 bp, Homo sapiens
  misc_feature 181, 298: n = A,T,C or G
ccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgntgccctcgggggagcattggccctggcggaacgcagcagccgcgaaggatccagccagaggatgccacgccagcccagcgctaccagggcttgcccaagggggggcgggccttgggnaagagccctacacggggcagcaccttaggatgggcagagactttgtttgcattttttgt

SEQ ID NO: 11925 - DNA, 196 bp, Homo sapiens
cccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggtt

SEQ ID NO: 11926 - DNA, 337 bp, Homo sapiens
  misc_feature 49: n = A,T,C or G
ctgctattctccgagcttcgcaatgccgcctaaggacgacaagaagaangaaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaagggaagttcccaactataaacttataaccccagctgtggtctctgagagactgaagattcgaggctccctggccagggcagcccttcaggagctccttagtaaaggacttatcaaactggtttcaaagcacaga

SEQ ID NO: 11927 - DNA, 333 bp, Homo sapiens
  misc_feature 7, 94, 97: n = A,T,C or G
ggccaanggtttttgcggggaggaggaggaaaccagcttttctggttaaggttaacaccagatggtgcccctcacttggtgtccttttaaaaantantttactgtagtccaataagatagcagctgtacaaaatgactaaaatagattgtaggatcatatggcgtatatcttggttcatcttcaaaatcagagactgagctttgaaactagtggtttttaatcaaagttggctttatagggaggagtataatgtatgcactactgttttaaaagaattagtgtgagtgtgtttttgtatgaatgagcccattcatggtaagtcttaagcttgt

SEQ ID NO: 11928 - DNA, 336 bp, Homo sapiens
gccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagaggagaaaggagagacaatttatgttcctgaggtctcagccttggatcaggagattatttgaagtagatcctgacactaaggaaatgctgaagcttttg

SEQ ID NO: 11929 - DNA, 327 bp, Homo sapiens
  misc_feature 240, 243, 291, 302, 309: n = A,T,C or G
gcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggctttggccaagtccatccaccacgctcgcgtgctgatccgccagcgccattatcaagggtccgcaagcaggnggngaacatcccgtccttcatttgtccgcctgggattcccaaaagcacatngacttcttctntgcgctntccctacggggggggccc

SEQ ID NO: 11930 - DNA, 337 bp, Homo sapiens
cagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagca

SEQ ID NO: 11931 - DNA, 325 bp, Homo sapiens
gcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcaaatagcagtaga

SEQ ID NO: 11932 - DNA, 334 bp, Homo sapiens
  misc_feature 165, 199, 210, 244, 248, 259, 278, 294, 308, 318: n = A,T,C or G
gcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggnaagggaccctcgaaatgtgggaccccagcccctnttccagcttgnaaatccctccacagccacggggacacccctgcancttnttcccacgggnaaaaggcttggaccaaaanacttttggacccgggnccctccctttgagnaaaaaacccnccctttgactgatgga

SEQ ID NO: 11933 - DNA, 104 bp, Homo sapiens
  misc_feature 21, 22, 34, 67, 78, 86: n = A,T,C or G
ctttgtatttcctaaatttanngtactcttggtnagctttctccacaagcttacctaaattgtttantactactttantactttanttaaaagtatacattttt

SEQ ID NO: 11934 - DNA, 399 bp, Homo sapiens
  misc_feature 2: n = A,T,C or G
ancgtaagactggagctcgcgcgcctgcaggtcgacactagtggatccaaagtgcctcttccccctgcaggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggc

SEQ ID NO: 11935 - DNA, 285 bp, Homo sapiens
  misc_feature 182, 252: n = A,T,C or G
tctgtgtctatgacaagacaaaacaaaagaaaagaaaacactggattgtaaacagatcaatccaatgttttctgttaccttaactaccagatcagattgctcacaaagtcaatctgatcaaatgttaagctattttgaaaacccaaatcaaccaaaaggaagaaaaaaatggtagatttggnggccatatgtagaacatggctgtagcagttaacaaatatgtagatagataaatatttttctttttcatgntggcaaagtgaagaatattgtttgcaaaaactg

SEQ ID NO: 11936 - DNA, 170 bp, Homo sapiens
aaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaa

SEQ ID NO: 11937 - DNA, 356 bp, Homo sapiens
ccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttc

SEQ ID NO: 11938 - DNA, 233 bp, Homo sapiens
  misc_feature 197, 206: n = A,T,C or G
ggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccattttttttttcttttttttnggcctaaanctctgtatggctgccttgggctataga

SEQ ID NO: 11939 - DNA, 165 bp, Homo sapiens
  misc_feature 106: n = A,T,C or G
ggctttggtcttagcactttccttctccagatcccccctacccaccccagtcccaaatccagtcctctggcccttgcctagccctgaattgcttctctaagctggngttcccatgcacagggccattcaggaagggctgggggagtgtgtgtggcaataaagctt

SEQ ID NO: 11940 - DNA, 331 bp, Homo sapiens
ggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagc

SEQ ID NO: 11941 - DNA, 174 bp, Homo sapiens
agacacatgtgtttcatttttagttttgttaaaaaaaaattctgacaaatcagaaatgggggttcaggagtggtggtgatgcaaaagatggaagccatggggtgggggctgtcaggggtgggggcagtagtgtcttccttcacccccccccctgggggcccccctccctggaag

SEQ ID NO: 11942 - DNA, 306 bp, Homo sapiens
ggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggagg

SEQ ID NO: 11943 - DNA, 337 bp, Homo sapiens
  misc_feature 2, 236: n = A,T,C or G
gngagccacatcacagtattacctttttgaagaaagaaaatcaccagcttcatgccctgaaattttataaatagtcatgataaaccaagtgtatgagagcagtattatctaggacatggatattgaattattgggagaggaatatggaagaataatgggttgtttccttttaatgttgtgatgttgctgagggcagatgaaccaagagccaggacacagtctagaagctttgaggnttcttttttcattgtttcttgaaattagaatttaagactgacattttgttgggggagttgaggagtgaagaaacacacatccccctctgttccctccattc

SEQ ID NO: 11944 - DNA, 130 bp, Homo sapiens
cttcaaggcccacctctctgtactctgggctctaaagttggaggtcaggttacctgaggtttgcaatttgcaacacccaccctccccccaatcagtgttcttatttcagtgacaataaaccatagagatg

SEQ ID NO: 11945 - DNA, 338 bp, Homo sapiens
cttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatc

SEQ ID NO: 11946 - DNA, 331 bp, Homo sapiens
tgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatc

SEQ ID NO: 11947 - DNA, 310 bp, Homo sapiens
  misc_feature 120, 123, 168, 205, 213, 222, 290: n = A,T,C or G
ttcggcacgagcagcactgagcccaataacttgaaggcccgcaattccttccgctacaacggactgattcaccgcaagactgtgggcgtggagccggcagccgacggcaaaggtgtcggnggnggtcattaagcggagatccggccagcgggaagcctgccacctccntatgtgcggaccaccatcaacaagaatgctcgcgccncgcttcangcagcattnagacacatggatcccgcaagaacaagtcccgccccgaacctgcgcatggaagccattccggagggccnaggcccattcttggcgcagc

SEQ ID NO: 11948 - DNA, 340 bp, Homo sapiens
  misc_feature 305, 322: n = A,T,C or G
caaacacatctgttttttaatgagcaccgtagctccctgggtttgtcaccttgaaaaggtttgttcacttattttgactacagttttttaactgtaacttgcattttattagtagggcttaaaaggtaagaaaatatttacaaagggcataaaagaggtggggctcagaagaaaataaatatctaatcctatattccattcttaagaatactcatttaaggaagactctgtctcaaaaacaaaaacaaaactcatttacctttttctttcccagaccgagtttagaaattttctcaggtgtgtgnttttgtttttgttttgntttgttttgagacggagt

SEQ ID NO: 11949 - DNA, 328 bp, Homo sapiens
caaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatacttttggttacctatgtacctgttacca

SEQ ID NO: 11950 - DNA, 395 bp, Homo sapiens
  misc_feature 6, 13, 25, 31, 32, 37, 41, 57: n = A,T,C or G
gggaancgtatantgagcctgtgtnaccttnngctgngacnctagtggatccaaagnaattcgcacgagtaatagaaccttcattctgatgatgaacagatgaaagagttaatattgaatagttttccaacgaatgaatgataaagttttgattacgtgggattggcatgtcattgttataccacgtcactataggttgaggatatccttgaaaatgacacacaaaattacaactgtcaccttcataaacttcttgagattcaatttcttgaagaaatgaaggtgggcaacgttgtgggcgttttcgaaaagaattttcaaaaaatctcatgttttcttccttctgttcggttttgaattcatcaattcgtgtagaagcagagagttgtaattct

SEQ ID NO: 11951 - DNA, 293 bp, Homo sapiens
gacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaacttta

SEQ ID NO: 11952 - DNA, 278 bp, Homo sapiens
  misc_feature 255, 271, 275: n = A,T,C or G
gccttctccatggccccgccctccccgcgtgtgcgccaggcctggggtccccgggagagcagagcttgcgcctcgggcatagggacgtggggtgcaggccgccaacatcagtggcagcagccagggccgtggtccagtcccactcggggatggagtgggccggcgccaaaccagtcactcggggaggaatgcgggaggagcgctcattccattctattaaattgcaggggacaaaattggggttggatatagaanaaactggtctggtganagcnaaa

SEQ ID NO: 11953 - DNA, 335 bp, Homo sapiens
  misc_feature 157, 262: n = A,T,C or G
ttcctctacttctcagccacctccctttctttatttcccttcccttcccccctactgatatgttactataggtgcttactttgtttggagaaaaaagtaaaactgatggaaggagctttggagtattgttttaattttttatctccttattttctgngaaatcttttcttggattaagatttagcctgagacattgcctgactcccatggtatagagaatgccataaagacaagaacatcttctaagagtctaacaaccagngctttccatcctaacttagaataacccaagagctccccctacacgatgggagaatgggtccatttgtctgcta

SEQ ID NO: 11954 - DNA, 105 bp, Homo sapiens
tgtgggcaggtactggtttatatgttataacttccgttttatctgtgttgtgtagttgaatggcttaatcgttgagtggtaaaataaaagattatattccaatac

SEQ ID NO: 11955 - DNA, 334 bp, Homo sapiens
tgctgtaggtcagcattggaaccaactcccaagctttcttcctcccacaaggagatattttgcaagtagctattcttaaatatgtttttgtaatcacagcctgggatactaaaattgaaactggtaacagacactgctaaaaaacttgttttgatttcactcgccacatcacttttacctctgattcacaaatcgcagtgaccaccaccattaagaaatgttttaaaaataagttttaggctgggcatggtggctcacgcctgtaattccagcactttgggaggccgaggcgggtggatcacgaggtcaggagatcaagaccaatctggctaac

SEQ ID NO: 11956 - DNA, 339 bp, Homo sapiens
gcttaccaggtcctcaaggcccaaagggtaacaaaggctctactggacccgctggccagaaaggtgacagtggtcttccagggcctcctgggcctccaggtccacctggtgaagtcattcagcctttaccaatcttgtcctccaaaaaaacgagaagacatactgaaggcatgcaagcagatgcagatgataatattcttgattactcggatggaatggaagaaatattttggttccctcaattccctgaaacaagacatcgagcatatgaaatttccaatgggtactcagaccaatccagcccgaacttgtaaagacctgcaactcagccatcctgac

SEQ ID NO: 11957 - DNA, 336 bp, Homo sapiens
cggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtggaaggttctaagacg

SEQ ID NO: 11958 - DNA, 234 bp, Homo sapiens
  misc_feature 2: n = A,T,C or G
gnggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaatt

SEQ ID NO: 11959 - DNA, 190 bp, Homo sapiens
  misc_feature 189: n = A,T,C or G
ttagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaatant

SEQ ID NO: 11960 - DNA, 400 bp, Homo sapiens
  misc_feature 5, 10: n = A,T,C or G
aaaanaaagnctggagctcgcgcgcctgcaggtcgacactagtggatccaaagctcgtgccgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcaagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctc

SEQ ID NO: 11961 - DNA, 335 bp, Homo sapiens
gaaagggttgcaccttgagaaaggaaggtgctagtccacatgaaatcccactcactgctggcggtcagtgggtagccgcatgtgctaggctgcataaaggaacagtcacaccaaattgagtgcgtctctctaattgccaatcaacccactgcatgtaaattctttttctgccattcatatatttattgatctacccatccaacaaatatttcatgagtaccaccacacttaccacagattccctggatatggcagtgaataaaacaaggtttctcctctcataaaacttatgttctagatgggagagaaagacattagaaaacaaataattttgt

SEQ ID NO: 11962 - DNA, 333 bp, Homo sapiens
cccaggtccattctctacactggggctggagttatctttctaaaatacaaatctgacgccaccaccactctagctaaaattcttcaatgactgccccatatcaagaaaaattctaaactctgaatatggtgccaagtactttaagatctggcctcacccactaattgcaagtattctgggatccagtcattcagaactacctagcgtttcccaaatacaaaatactgattcttcaatctatcctttgcttattttgtgccatccatttgtcctagaatgactttcctcatcatcactccagtgaaagcttattcaactattttaacacaagtt

SEQ ID NO: 11963 - DNA, 332 bp, Homo sapiens
  misc_feature 215, 227, 282, 303, 321: n = A,T,C or G
gagagaccagggtcttgggtagaaagtgctggagccaaggctgaaagtgcaaaggggcccctgggggctctgcagagcaagcgagaggcaggcagagccaggggcgggaagtccagtggtggggtctgccgtgccctggacaccgcccaggagaggccccggtttgcagaccagagaccccagagtggcttcttgtggttcccttggagtgcggnggcttgcccttntcctgaggtcccaaggaggcaggcagggccctgccgaccccccagccctgacccntgtgcaggccgggcttgtggntctggacaccccctggcntcaagcagcca

SEQ ID NO: 11964 - DNA, 333 bp, Homo sapiens
gctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaatata

SEQ ID NO: 11965 - DNA, 155 bp, Homo sapiens
ttcggcacgagcttggcttgcttcctcttgactattgggagtagtgctaatacagacacgggggtgcaaatatctctttgagactctgcctttaattcctttaccacccagagttttatctttagcaaaataaccattaaagttgtttgcctttt

SEQ ID NO: 11966 - DNA, 147 bp, Homo sapiens
acatctcactactcatccctccttccccatccccatcaccttggtttctcactggggatagttagagtgtcttaaatggactctacttctagattttgccttcttttcccaacccctaccccctggccctgcattctcacactgcag

SEQ ID NO: 11967 - DNA, 326 bp, Homo sapiens
  misc_feature 245, 317, 325: n = A,T,C or G
agctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagccccggaggttgcgcttgagcttggcttgctcgcttgggtcttggatgtcgggttcgaccacttggccgatgggaatggnctgtcacagtctgctcctttttttttgtccgccacacgtaactgaaatgctcctttaaataaagcgtttggngtttaagnt

SEQ ID NO: 11968 - DNA, 322 bp, Homo sapiens
  misc_feature 275: n = A,T,C or G
ttcggcacgaggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctgggggttggcttccatgaccaagatctatgggggacgtcaganaaacggcgtcatgcccagccacttcagccgaggctccaagagtgtgg

SEQ ID NO: 11969 - DNA, 337 bp, Homo sapiens
agtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatg

SEQ ID NO: 11970 - DNA, 195 bp, Homo sapiens
tagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaacc

SEQ ID NO: 11971 - DNA, 316 bp, Homo sapiens
ccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtgggtttgactatttctgtatgtctccatctattgatgagg

SEQ ID NO: 11972 - DNA, 312 bp, Homo sapiens
attcaactgaaaatgctatgataacattttatcgtttgctttaaaaatgtgctttgttttcaaataatctttacatagtgaactttggtggcgttagtgatatgtttatgcctatttcttttttttacacaaattccttggcatattttttcataaagaacaaaaaataaaatcaaaatttatttttaattcatgcttattgggatttaattattcagagcttaaaatattttgttatgtttatacactgtaaagctatctgttttatgcatttgttttgtctaaatgtatttatgaaagaaatacattaga

SEQ ID NO: 11973 - DNA, 171 bp, Homo sapiens
cggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaaccttacc

SEQ ID NO: 11974 - DNA, 334 bp, Homo sapiens
caacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctaca

SEQ ID NO: 11975 - DNA, 336 bp, Homo sapiens
catagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtc

SEQ ID NO: 11976 - DNA, 146 bp, Homo sapiens
gggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttt

SEQ ID NO: 11977 - DNA, 198 bp, Homo sapiens
gctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggttta

SEQ ID NO: 11978 - DNA, 343 bp, Homo sapiens
ttcggcacgagctcaaactcctgacctcaggtgatccacctacctcggcctcccaaagtgctgggattgcaggcatgagccaccacgcctggccagagtagttaccgtgttctcagtgatgagagtacatcagagaacaaggtagacacactcctcccaaggagctcacagtcttttggggataggcggatattgatcaggtagccaaaatatgtaattacgaactgggatgagagcaagaaggggcagtattagggacctgagagggcatagaacagagtcctgctcagtctgagggtcagggaatacttttctggaaggaatgatgcttgagcagagtctg

SEQ ID NO: 11979 - DNA, 328 bp, Homo sapiens
tgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctg

SEQ ID NO: 11980 - DNA, 353 bp, Homo sapiens
aaaagagggaagtcaatattagcttactttctatatctgcatatagaatacatatacagtataaacacacatactcacatactgcatgttagaagatgaattaatattctaacatgcagcatttttcatgaatactttatataataaatcttaattttctcacacaaacagaggtcccaattgtacattcataaagacaaaaagccttataaataaaatagcaaaagaagaaacatcacattaataattataaaaatctcatccatgatagaattagttatacagaaaacagatattcagattcggttgtattccaggcacaagactttacagtggggataaataaggtcctt

SEQ ID NO: 11981 - DNA, 332 bp, Homo sapiens
tgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatc

SEQ ID NO: 11982 - DNA, 337 bp, Homo sapiens
cccagagcaccttcgtggcgcacagcagggtcaccaggatgccccagatgtgcaaggccacgtcaggtgagagggggcggccaggtgcacgcgggaagacctgagggcgaactgcttgccggtgtcaagggctaccgcggggaaggtacccttaggactgggtgcagtgaggaacgggaatcattaattaattctgggaacgctgctgttagatgcgggagacttgaggtcttccaggcctttgttgaccccgccccgttctaaccctaatcttgcaccataaccgtgcacctgaccctccagagtgcactgggccagctctcccatttctccttgt

SEQ ID NO: 11983 - DNA, 338 bp, Homo sapiens
cacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagt

SEQ ID NO: 11984 - DNA, 331 bp, Homo sapiens
  misc_feature 3, 4, 14, 27, 28, 43, 89, 172: n = A,T,C or G
ggnnaccccaaagnaaggcacatggcnngaaggcgctgacttncttgggagatgccataaagcacctggttgatctcaagggcaccttngcccagctgagtgaactgcactgtgacaagctgcatgtggatcctgagaacttcaagctcctgggaaatgtgctggggaccgntttggcaatccatttcggcaaagaattcacccctgaggtgcaggcttcctgggcagaagatggtgactggagtggccagtgccctgtcctccagataccactgagctcactgcccatgatgcagagctttcaaggataggctttattctgcaagcaatc

SEQ ID NO: 11985 - DNA, 335 bp, Homo sapiens
gctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacc

SEQ ID NO: 11986 - DNA, 313 bp, Homo sapiens
  misc_feature 247, 310, 312: n = A,T,C or G
gcacgagcggcacgaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggnggcgcatgattcactgagcaaacagcacttttacagaagaaaatctttattttgtaatatggngng

SEQ ID NO: 11987 - DNA, 184 bp, Homo sapiens
ttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatat

SEQ ID NO: 11988 - DNA, 254 bp, Homo sapiens
tgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggattattgg

SEQ ID NO: 11989 - DNA, 302 bp, Homo sapiens
gtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtg

SEQ ID NO: 11990 - DNA, 332 bp, Homo sapiens
ctggagttttctggaggttgaatctggaatgaccagttcttgggtgtgccctgttgaggagctaactggtgcaggagctatctggggtgaaatcactacccatgagaagaaaagcctctcctccacctttcccaggctgaaaagacagtttggcttggggatggcattgggtggagctttcagctgagactaaaggcccaactctcctcccagtgtgaggagaggttgaccctacactcttcctgctgccacaggaactgtggaggcagctgttgaggaattacccctgattgaaggagggcataaatgctgattctcctctgaaggtctgt

SEQ ID NO: 11991 - DNA, 280 bp, Homo sapiens
tctggctgagttctcaaaagaaggaagagaagatttgttatacaaattgaattaataatagtatacatataaactattttaatttagtaaaacctaaactggtctttaacaagaagtgacaggataggtgaaaatgtattttggggaaaagtattttgagttttgctgaattaatatggttggtaaatctctctctgtgtaggatcactgtttaatgaaataatgcatattttttttctgccacccaaataaagatttttatctgtgttgaatttagtgc

SEQ ID NO: 11992 - DNA, 329 bp, Homo sapiens
aaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatat

SEQ ID NO: 11993 - DNA, 223 bp, Homo sapiens
ttcggcacgaggtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactac

SEQ ID NO: 11994 - DNA, 337 bp, Homo sapiens
ggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcgg

SEQ ID NO: 11995 - DNA, 335 bp, Homo sapiens
  misc_feature 264, 265: n = A,T,C or G
gctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgtnngtgatgtggttatctcctcagatggccagtttgccctctcaggctcctgggatggaaccctgcgcctctg

SEQ ID NO: 11996 - DNA, 337 bp, Homo sapiens
gaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgc

SEQ ID NO: 11997 - DNA, 297 bp, Homo sapiens
ggcacatgcatgtaatcccagctactcaggaggctgaggcaggagaatcgcttgaactccagaggcggaggttgcagtgagccaagattgtgccactgcactccagcctgggggacagagcgagattctgcctaaaaaacaaagaagaaagaaaagaaagagagaaagaaagaaagaaagaaagaaagaaagaaagaaagaaagaaagaaggaaagagagaaagaaagaaagagaaagagagaaagaaaagaaagaaagaaagagagaaaggaaagaaagaaagggagaaagaaaag

SEQ ID NO: 11998 - DNA, 281 bp, Homo sapiens
ctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggtt

SEQ ID NO: 11999 - DNA, 333 bp, Homo sapiens
atgctagcctcacgaaactggaataagccttcgaaaagaaattgtccttgaagcttgtatctgatatcagcactggattgtagaacttgttgctgattttgaccttgtattgaagttaactgttccccttggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatg

SEQ ID NO: 12000 - DNA, 331 bp, Homo sapiens
gtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagaggg

SEQ ID NO: 12001 - DNA, 333 bp, Homo sapiens
gcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggc

SEQ ID NO: 12002 - DNA, 400 bp, Homo sapiens
  misc_feature 6, 11: n = A,T,C or G
aaaacnaaagnctggagctcgcgcgcctgcaggtcgacactagtggatccaaagtgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcacccgtttggctcgatattataagaccaagcgagtcctccctcccaattggaaatatgaat

SEQ ID NO: 12003 - DNA, 338 bp, Homo sapiens
tgtggattggcccgtagctaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttg

SEQ ID NO: 12004 - DNA, 331 bp, Homo sapiens
aaaaatgtatgtgtcagttctttaaaacaaagaaatgaattgctatcaggaaaaaaagcataggattttgaatataccaaacataatccaaaagttcaggtaaagcataggattttgaatttactaaacataatccataagttcagataaagcataggattttgaatatactaaacataatccataagttcaggtgtcctcacaggaacattgattaaaaatatactaaacctatgaattagtagtattttgtatctttataaaactcgctttccccatgtagatgatttcttgcctgaaaagcacagcttacctattttcttccttccta

SEQ ID NO: 12005 - DNA, 332 bp, Homo sapiens
ctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagtttggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcc

SEQ ID NO: 12006 - DNA, 333 bp, Homo sapiens
aatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagca

SEQ ID NO: 12007 - DNA, 381 bp, Homo sapiens
aaagctggagctcgcgcgcctgaggtcgacactagtggatcaaagaattcggacgagtggcctggcagtcctgctcacagtgttctgtgcctgtgtgctcccaccctttcctcctgctgctgaggaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtat

SEQ ID NO: 12008 - DNA, 320 bp, Homo sapiens
ccgcacgctacgaggcccacacaccacccagaaggtggagccccggccgggttacgaggaccacccagctgtctggagagatgaagaaaatgaggttcaaagagatgaagtctcttgcctaaagtcagtgacagaaagtgacagagctgggatgtgaatcctggtctgactctacagtcccacatggtagatggaacctccgagcaacacctaaacaaagggagttgatgcctccgaacagagtaatgtcgctggagacactaagcatcgtcggcccctggcaggagctccctaaatatgtgttggattggattggaaga

SEQ ID NO: 12009 - DNA, 339 bp, Homo sapiens
agaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtgggaggacgacaaggtggggacagacttgctggaggagg

SEQ ID NO: 12010 - DNA, 337 bp, Homo sapiens
agttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatgg

SEQ ID NO: 12011 - DNA, 332 bp, Homo sapiens
gtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctgg

SEQ ID NO: 12012 - DNA, 288 bp, Homo sapiens
cttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtg

SEQ ID NO: 12013 - DNA, 226 bp, Homo sapiens
caaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgc

SEQ ID NO: 12014 - DNA, 238 bp, Homo sapiens
ggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcc

SEQ ID NO: 12015 - DNA, 274 bp, Homo sapiens
caaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttttgtttttcatatcagactaataaaaagaaattag

SEQ ID NO: 12016 - DNA, 338 bp, Homo sapiens
agtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtacctttaaagctgtcaccatgttatattttcttttaagacattaatttaagtaattttatattt

SEQ ID NO: 12017 - DNA, 337 bp, Homo sapiens
  misc_feature 90, 281: n = A,T,C or G
aaaactttctctttgccatttcttcttcttcttttttaactgaaagctgaatccttccatttcttctgcacatctacttgcttaaattgngggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgnggcttttgaatatcttccacagagggaagtttaaaacccaaacttccaaaggttta

SEQ ID NO: 12018 - DNA, 337 bp, Homo sapiens
ccaagtttcagttagaaaataccgaacccctgattagactttctgggtagccagcttgcaagttcatgaatatccaaatgtctcctgaacgccttaagagcagactgggagagaaatccgtctctccctttatcacttatgctcatggctttcttccactgactctgaagagaaagggaaaaggaaaaactctagggtttttaaaggacctatacttatttaaaaacttcttgttttattcttacagcccaaatcattaaccctcgtgttctgagtgatagggggaaatgctaaggggagtcagagcctggttatcagcattttggatgaccatata

SEQ ID NO: 12019 - DNA, 332 bp, Homo sapiens
  misc_feature 263: n = A,T,C or G
gccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccantaactgatgatgtgcgggttcaggaggtacccaaactgaaggtatgtgcactgcgcgtgaccagccggg

SEQ ID NO: 12020 - DNA, 329 bp, Homo sapiens
  misc_feature 2, 300: n = A,T,C or G
gngatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggggtttttacagaggagaagcaatgggncttagctctttctctattatgttatcatc

SEQ ID NO: 12021 - DNA, 338 bp, Homo sapiens
gctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagatt

SEQ ID NO: 12022 - DNA, 246 bp, Homo sapiens
ttcggcacgagggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtgagccatggtcacaccactgcaccccaacctgggccacctagcaagatc

SEQ ID NO: 12023 - DNA, 334 bp, Homo sapiens
  misc_feature 267, 323: n = A,T,C or G
ccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggngaacattcccgtccttcattgtccgcctggattcccagaagcacatcgactttttntctgcgctctt

SEQ ID NO: 12024 - DNA, 337 bp, Homo sapiens
  misc_feature 35, 321: n = A,T,C or G
aagacccagtggatcatgttggaaatgcaactgcntcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggntttgttgaccttattt

SEQ ID NO: 12025 - DNA, 295 bp, Homo sapiens
  misc_feature 188: n = A,T,C or G
cactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggngggaggaagcaaaagactctgtacctattttgtatgtgtataataatttgagatgtttttaattattttgattgctggaataaagcatgtggaaatgacccaaacat

SEQ ID NO: 12026 - DNA, 338 bp, Homo sapiens
  misc_feature 281: n = A,T,C or G
cgagtgaagatgcaaaacagaagattttcatgcaggaatcagatgcctcgaatttcctcaagaggcgcggcaagcggtcccccaagtcccgagatgaggtcaatgtggaaaacaagcagaagcttcgggttgatgagctgcggagagaatattacgaggaacaaaggaatgaatttgagaacttcgtggaggaacaaaacgatgagcaggaagagaggagccgggaggctgtggagcagtggcgccagtggcactatgacggcctgcacccatcctatctntacaaccgccaccacacctgatcccatcctgaagccggccaagaagacaaagcttgt

SEQ ID NO: 12027 - DNA, 319 bp, Homo sapiens
gacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaacc

SEQ ID NO: 12028 - DNA, 243 bp, Homo sapiens
cggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattaagtttttaaaatcagtactttttaatggaaacaacttgaccaaaaattactgattttaaaaactaataacttaaaactgccacacgc

SEQ ID NO: 12029 - DNA, 339 bp, Homo sapiens
  misc_feature 192: n = A,T,C or G
ccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttanacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggccttt

SEQ ID NO: 12030 - DNA, 326 bp, Homo sapiens
ttcggcacgagcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattct

SEQ ID NO: 12031 - DNA, 137 bp, Homo sapiens
ccctctcctctctgtaagcccatgccctgtcttcccagggacttgtgagcctcttccctcgacggtcctcttctctccttccagtcctctccccctgctgtctgcagcccctccccggggagttggtgctttctttt

SEQ ID NO: 12032 - DNA, 331 bp, Homo sapiens
  misc_feature 21, 253, 302, 309, 323: n = A,T,C or G
gctttgtgcggcagcgtccgntcactcctcccctgctcgctgcaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggtaagacaaaggcctggagccgggggagggctgggcggtttccgctccccgagngggattaataagtgcggctctcgtcctcaacaggaggctagcgaagcgnacctggngggtctgttcgaanataccaac

SEQ ID NO: 12033 - DNA, 335 bp, Homo sapiens
  misc_feature 154, 303: n = A,T,C or G
gactgaggaagacccggaaacttaggggccacgtgagccacggccacggccgcataggcaagcaccggaagcaccccggcggccgcggtaatgcttggtggtctgcatcaccaccggatcaacttcgacaaataccacccaggctactttgggnaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggngcgatcgggctctataaagttctgggaaaggg

SEQ ID NO: 12034 - DNA, 268 bp, Homo sapiens
  misc_feature 93, 128: n = A,T,C or G
ttcggcacgagaaatatgacagcatgttccatacccctgctttagccatctgtgggaaaccagcaaactgaaaaagacacctctgcaaaatgngcctcaagtccatttcttgggatcgctcgtttggngcacctctcgtgggagacaatcagagaacaacatatacttgtgccttattttcaaagaatctatttacactactatgaatattccactgaagagtcaatgatgtaaatgataaccaccaaatctcaaaaatatactcacc

SEQ ID NO: 12035 - DNA, 337 bp, Homo sapiens
gttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttatt

SEQ ID NO: 12036 - DNA, 320 bp, Homo sapiens
ttcggcacgagaaaaaatatattttaatctacattttgaaattgaaaatctgagactatttatgtaactgatagaagcctgtatcctacagaacgggagtgggattgggaagcaattggctacagctccttatcctagctactaacatttttacaagtgaatattgttatatagtcagatttataacattcatattatataacatgatataaatgtgtacatgtgtatgtgtgtactttgtatgcttcttagaaatagtactggcagacacaagttttggatattagaaaaatttacatacactataactcttacaaagt

SEQ ID NO: 12037 - DNA, 238 bp, Homo sapiens
aaaatgtattgcttttgatatttctcttccgagatgaacaagtagcatgtaatgcaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggatttttttttttttt

SEQ ID NO: 12038 - DNA, 306 bp, Homo sapiens
  misc_feature 296: n = A,T,C or G
aacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaaanagccagcgtg

SEQ ID NO: 12039 - DNA, 336 bp, Homo sapiens
  misc_feature 176: n = A,T,C or G
gtggggccggcggcaagtgctgtgatgcggttccggggaggggccgtcgggtagaggctgaataccagtttccgagcggcaaggcagcgatggcgatttttagtgtgtatgtggtgaacaaagctggcggcttgatttaccagttggacagctacgcgccacgggctgaggctganaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgc

SEQ ID NO: 12040 - DNA, 333 bp, Homo sapiens
aacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtc

SEQ ID NO: 12041 - DNA, 132 bp, Homo sapiens
cattcacctattgaaagacttcttggtggtttccaagttttggcaattatgaataaagctgttgtaaacatctttgtgcaggtttttctatgggcatgtttttaattcatttgaataaataccaagagcttc

SEQ ID NO: 12042 - DNA, 324 bp, Homo sapiens
  misc_feature 304: n = A,T,C or G
ttcggcacgaggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttgggggaagtaccttttggctaaagaccagacgaagattcccatcaagcgctcggacatgctgaaggacatcatcaaagaatacactgatgtgtnccccgaaatcattgaacgag

SEQ ID NO: 12043 - DNA, 238 bp, Homo sapiens
gcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgt

SEQ ID NO: 12044 - DNA, 169 bp, Homo sapiens
aaaagaccttgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgt

SEQ ID NO: 12045 - DNA, 338 bp, Homo sapiens
gccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacga

SEQ ID NO: 12046 - DNA, 334 bp, Homo sapiens
tggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaaga

SEQ ID NO: 12047 - DNA, 339 bp, Homo sapiens
caataatgcagtttactattgcaacagggctgctgctcagagcaaattaggtcactacacagatgcgataaaggattgtgaaaaagcaatagcaattgattcaaagtacagcaaggcctatgggagaatggggctggccctcactgccttgaataaatttgaagaagcagttacaagttatcaaaaggcattagatcttgaccctgaaaatgattcctataagtcaaatctgaaaatagcagaacagaagttaagagaggtatccagtcctacaggaactggactgagctttgacatggctagcttgataaataatccagccttcattagtatggcggc

SEQ ID NO: 12048 - DNA, 339 bp, Homo sapiens
  misc_feature 331: n = A,T,C or G
ctcgtgccgctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgccctttaaaggaaccaatgagtcccctggaacgccagatgcgtgaaattggaagagaactttgccgntgaagctg

SEQ ID NO: 12049 - DNA, 337 bp, Homo sapiens
aaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttat

SEQ ID NO: 12050 - DNA, 354 bp, Homo sapiens
gaatccagcaaaggtggaaaacagtgccatccttctccccaactggttttgttttgtaaaataactttttgtgacagtgttacttattagtaacatgcagtgggtttgttatggttaacaagttggtgagcattattgagaggtgaagccagctgagcttctgggttgggtggggacttggagaacttttgtgtctagctaaaggattgtaaatgcaccaatcaatgctcagtgtctagctaaaggattgtaaatgcaccaatcagcactctgtaaaattgaccaatcagcgttctgtaaaatggaccaatcagtggtctgtaaaatggaccagtcagcaggatgtgggcgggg

SEQ ID NO: 12051 - DNA, 346 bp, Homo sapiens
ttcggcacgaggacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcg

SEQ ID NO: 12052 - DNA, 333 bp, Homo sapiens
gtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatca

SEQ ID NO: 12053 - DNA, 348 bp, Homo sapiens
gtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggt

SEQ ID NO: 12054 - DNA, 316 bp, Homo sapiens
  misc_feature 184, 310: n = A,T,C or G
ggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctnactccccttccaccctcagctccaccctcagcagatgataatatcaagacacctgctgagcgtctgggggggccgtttccaccctcagcggatgataatctcaagacaccttccgagcgtcagctnactccc

SEQ ID NO: 12055 - DNA, 339 bp, Homo sapiens
attgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattgg

SEQ ID NO: 12056 - DNA, 125 bp, Homo sapiens
ctcgtgccgggagcggagctcaaggctgcggaggcggaggtggagctgagcgcaagacgacttcgggcgtggggggcccgggtgcaggcccaaggccacaccctgcaggtagccgggctgagagg

SEQ ID NO: 12057 - DNA, 315 bp, Homo sapiens
  misc_feature 260, 269: n = A,T,C or G
ccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccacccttgggagacagaccccacctccttgggtagtgagcagtgagcagaaagctgtgaacaggctggcttgctggaggtggggcgaggcagnccgactgtnctaaagtaacgcaataaacgcattatcagccaaagctgggaatggc

SEQ ID NO: 12058 - DNA, 286 bp, Homo sapiens
gctggaggcccttatccttagcagaccaacacagaaagagaaaaccaaatactgcatgttctcacttataagtgagagttaaatgatgagaacatatggacacatagaggggaacaacacacactggggccttttggaggatagagggtgtgaggagggagaggatcaagaaaaacaactaatgggtactaagcttaacacctgggtgatgaaataatctatgcaacaaatcccctatgacacaagtttacctatgtaacaaacctgcacttgtacccctgaactt

SEQ ID NO: 12059 - DNA, 332 bp, Homo sapiens
ccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccaggacaggccgtcccccaccccatcctgtagaagtccattccccttttccctcctgtgctctgtcccccaaggagtcatggaactcagggtactgggcctcaacgggaacctgagacagctgcagcttcgcagcccttcccggag

SEQ ID NO: 12060 - DNA, 105 bp, Homo sapiens
  misc_feature 6, 16, 25, 26, 35, 45, 46, 51, 58, 59, 63, 68, 69, 71, 81,84: n = A,T,C or G
aatttnaataattcgncgcgagctnntgccgaatncggaaaaagnnacaangaagccnngcgncaacnnanccgacagatngancgagagaaacctcggtagcac

SEQ ID NO: 12061 - DNA, 116 bp, Homo sapiens
  misc_feature 48, 70, 75, 76, 88, 97: n = A,T,C or G
cactagtggattcaaagaattcggttacgagcatcattttcctctatnagcattaattaaagataaagangtagnnaatgcgtgaatntatcaaagntataaagaaagaggcccta

SEQ ID NO: 12062 - DNA, 100 bp, Homo sapiens
  misc_feature 19, 24, 30: n = A,T,C or G
tggagcttgcgcgccccantaggncactanaggaattcagttatagggaaagaggaaaatcctaatcccctaattggaagacactgagcgcataaatggg

SEQ ID NO: 12063 - DNA, 103 bp, Homo sapiens
  misc_feature 8, 15, 26, 36, 42, 46, 49, 63, 65, 66, 68, 75: n = A,T,C or G
aagtttcnggagctngcgcgccccantagggcactngagganccanagnaagtcggcacgcanannanactctcncatatgccctcttacagaatttaagaga

SEQ ID NO: 12064 - DNA, 130 bp, Homo sapiens
  misc_feature 5, 16, 41, 48, 61, 63, 64, 79, 107, 125, 127: n = A,T,C or G
cagcnctttgagaggntgaggcggggaggattgcatgagcncaggagntcgagaccaactngnncaacatggcgaaacnctgtctctacgtaaaatacaaaaattanctgggcgggggggcacgntnctg

SEQ ID NO: 12065 - DNA, 100 bp, Homo sapiens
  misc_feature 4, 11, 51, 55, 58, 61, 63, 70: n = A,T,C or G
gctnattcccncatccccatgattctttaaaaatgtaaaaagctagcaggnctgnagnccngngggtggnaggctgcagggccttacgtcactccttgag

SEQ ID NO: 12066 - DNA, 100 bp, Homo sapiens
  misc_feature 4, 9, 32, 36, 45, 46, 50, 53, 62, 65, 76, 82, 89: n = A,T,C or G
gatngacgncatcggagggaccaaggtcaaanggtncaaaggggnnactnagncgctgaganacnaagaagctgcnccgaangacccancgaggcctgcg

SEQ ID NO: 12067 - DNA, 100 bp, Homo sapiens
  misc_feature 12, 20, 40, 54, 55, 73, 76, 84, 98: n = A,T,C or G
ccaaacagggcnaactgtgntacactgagagccgtatcanattctgacagcacnnacgcactagcgggcgcgnggnaggggagnaagtggatcaagangg

SEQ ID NO: 12068 - DNA, 100 bp, Homo sapiens
  misc_feature 5, 9, 33, 60, 61, 62, 64, 73, 75, 99: n = A,T,C or G
agttngggngcttgcgggtcgccactaggggantcaaagaattcggttcgagctcgcgannnantggggacgncnttgcagtctttctctgaccaatgng

SEQ ID NO: 12069 - DNA, 103 bp, Homo sapiens
  misc_feature 59, 78, 80, 96: n = A,T,C or G
aacagcttgtgcacctgcgcactgagcccatggcttcatagctccctggtggaagaganaaaaagaggaacgcagggncngggaggccaggggggnagcgctc

SEQ ID NO: 12070 - DNA, 100 bp, Homo sapiens
  misc_feature 9, 29, 30, 39, 45, 48, 49, 50, 55, 61, 62, 65, 67, 73, 79,81, 85, 87, 88: n = A,T,C or G
ttaatatgntaaattataaagtataattnnttgactgantgaccnatnnntctanagcatnnctngnatttanagatantnggtncnnttgggctttata

SEQ ID NO: 12071 - DNA, 100 bp, Homo sapiens
  misc_feature 11, 13, 70: n = A,T,C or G
tcctgtgaaanantggtacaatatgtacatactaacatcgctaatatgggcaaacgatcaaatttttagntttcttggctttgcgtatttgacaatcagt

SEQ ID NO: 12072 - DNA, 100 bp, Homo sapiens
  misc_feature 6, 38, 60, 76, 94: n = A,T,C or G
ctggangacatgaatatgagcatttctgacctcaatanagaaagccgggaggaggtgatnatatcttggcctgtgnccctggggccctttgggncagctg

SEQ ID NO: 12073 - DNA, 170 bp, Homo sapiens
  misc_feature 9, 11, 37, 40, 41, 48, 52, 91, 103, 122, 132, 161, 162: n = A,T,C or G
cgcctgcanancccactagtggattaaaagaattcgnttnnagcaacnctgnggaccggctggcccctggggacctggggagaacacgggncttgcgctgggnctacctgagtggaaaccgnatcaccgaantgtcccttggggcgctgggcccatctcgnnagctggag

SEQ ID NO: 12074 - DNA, 100 bp, Homo sapiens
  misc_feature 6, 8, 35, 44, 57, 71: n = A,T,C or G
caactnanccaagaggggattagtagttaactatnaaccctaanactttgtgtgccnggggaccctgtgantaggcctataattgctagcttgactgagt

SEQ ID NO: 12075 - DNA, 104 bp, Homo sapiens
  misc_feature 6, 9, 30, 31, 37, 41, 48, 52, 54, 65: n = A,T,C or G
tttttnggntagaaaattcacagtatgganngattgntaanagagagngctngnaaccatgggtnaacaggaaaggctacctaacttcacatatctgcaaccag

SEQ ID NO: 12076 - DNA, 103 bp, Homo sapiens
  misc_feature 8, 20, 37, 49, 61, 62, 64, 67, 77, 80, 95: n = A,T,C or G
ggcgcggnacgaatgcatcntagcaattacctgattnccaaagtccttnagtagcaaaggnnanctnattcgcgganttntgacctatcctaagnttatgagg

SEQ ID NO: 12077 - DNA, 100 bp, Homo sapiens
  misc_feature 14, 27, 31, 34, 43, 67, 72, 74, 83, 86, 87, 94: n = A,T,C or G
gatcaaggctgccnagctgtgagggantggnctnggatgctcncattatcccataagcagagaaggnaaaangngaaaaaggnganntgtgaangcgtga

SEQ ID NO: 12078 - DNA, 100 bp, Homo sapiens
  misc_feature 5, 14, 35, 37, 47, 57, 58, 68, 71, 77, 78, 83, 87, 94: n = A,T,C or G
cattnaaacaagantttgaacccatggggacgcananatcaacatgnggctttctgnncataaaagtntgnaatttnntagcngtgngggggcnaaagct

SEQ ID NO: 12079 - DNA, 167 bp, Homo sapiens
  misc_feature 4, 15, 32, 34, 51, 52, 64, 66, 82, 98, 102, 154: n = A,T,C or G
ctgncgagaaggagnagggcccctctgggtgnanatgcacccatccccagnncaggaaaccatntnccccaggaccttatgnctgggactcaggagcnctanggaaaaggaattctaaaacatgggggaaggggaggtagagcacttgatgggntgaaaaagtgagg

SEQ ID NO: 12080 - DNA, 100 bp, Homo sapiens
  misc_feature 11, 17, 35, 42, 80, 83: n = A,T,C or G
tcagcgtaccncacganggggcgcgccgttcgcgntttcagnctggaggaggtcagggtgtccgaaattcacaagaaggngcnccggaccttctgcgttt

SEQ ID NO: 12081 - DNA, 109 bp, Homo sapiens
  misc_feature 3, 14, 28, 38, 40, 41, 46, 48, 51, 67, 71, 85, 90: n = A,T,C or G
ccncactaggggantcaaagaattcgtnacgagatttngnngaggngntgnacaactatattatatntaanttcttatttccttntgggnttatgataagttttttaat

SEQ ID NO: 12082 - DNA, 100 bp, Homo sapiens
  misc_feature 7, 12, 29, 30, 36: n = A,T,C or G
gctgganaaatngaccggcgtgtttgctnntcgccnatccaccggagccgacaaggtgagagagcgtcttcccctcattattttcctgaggaacagactt

SEQ ID NO: 12083 - DNA, 178 bp, Homo sapiens
  misc_feature 4, 8, 50, 55, 59, 76, 81, 82, 95, 136: n = A,T,C or G
cgcntgcnggtcccactagtggattcaaagaattcggttcgaggcgatgngcatntgtngggacatctggcacaancgccnnaaaaccgggggcncgagaaagccctaccacaagtaagcggaagtatgagttggngcgcccagctgccaacaccaagattggcccccggcgcatcca

SEQ ID NO: 12084 - DNA, 100 bp, Homo sapiens
  misc_feature 35, 79: n = A,T,C or G
gatttactaatcccctaacctgttcatgtgtacancgactaacccataaaggtttgatggaatgtaagaatcttatatncttctgaccagtgaatgtttg

SEQ ID NO: 12085 - DNA, 100 bp, Homo sapiens
  misc_feature 15, 24, 40, 51, 59, 60, 65, 70, 84, 89, 90, 95, 96: n = A,T,C or G
tgggcgcttgcggancccactagnggattcaaagaattcntttcgagctancctgtgcnngtgcnccctnacaatgaacatgtnaaggnngaatnngcgg

SEQ ID NO: 12086 - DNA, 100 bp, Homo sapiens
  misc_feature 16, 26, 34, 38, 43, 68, 75, 94: n = A,T,C or G
aaaaaggcacaaaaantctggagctngcgcgccngcantaggncactagaggatccaaagaattcagntcgaganatgaggaagcgaggacgcntcgggt

SEQ ID NO: 12087 - DNA, 100 bp, Homo sapiens
  misc_feature 3, 6, 11, 38, 39, 52, 56, 77, 80, 87, 90: n = A,T,C or G
cangcngatcnatgagtatatttgggccagctgcaganntgagcctggaggnccangtcaccctgaattaggagaanccncgaattnccnaggaccctga

SEQ ID NO: 12088 - DNA, 100 bp, Homo sapiens
  misc_feature 30, 45, 50, 60, 77: n = A,T,C or G
ggcccggaaatttctggagcttgcgcgccngcactagggcactanaggantccaaggaanacctactaagctccgangctccgtagttacatattattac

SEQ ID NO: 12089 - DNA, 100 bp, Homo sapiens
  misc_feature 11, 18, 35, 45, 55, 85: n = A,T,C or G
ggcatcaggangccttgnggcgtgggaaggttctncttcctcttnctctctcggnccttctttgggcagcgggggctgaccccancttgcgcattggctg

SEQ ID NO: 12090 - DNA, 118 bp, Homo sapiens
  misc_feature 7, 11, 36, 39, 41, 42, 46, 49, 62, 69, 82, 91, 96, 106: n = A,T,C or G
cactagnggantcaaagaattcggtcgagggctggnggngnntggncgnacaataccacttncgctgtnaccggtagaagcncgccatcanaagantgaaggagtngaaagaccagta

SEQ ID NO: 12091 - DNA, 100 bp, Homo sapiens
  misc_feature 10, 22, 32, 41, 48, 61: n = A,T,C or G
ctaatccttnaaaaacttattntcttacctgncttgctgcnaagatcnttacatttctaantttctgagggcttagaatgttgttgagatcacctgggta

SEQ ID NO: 12092 - DNA, 103 bp, Homo sapiens
  misc_feature 52: n = A,T,C or G
tgcggaagtgcaaatccataatcccagcaacttgaaaggcggaaacaggagnaacgcgggaacccgggagggagaggaggcaagagaggcaaaaccgcaccac

SEQ ID NO: 12093 - DNA, 100 bp, Homo sapiens
  misc_feature 5, 8, 29, 37, 50, 56, 61, 77, 84, 98: n = A,T,C or G
gcctncantaggagattaaaggattcaantaataggntgagaggaagaangagaanaaaancaattatgtaatggangaatggnaggatgtctggatntg

SEQ ID NO: 12094 - DNA, 100 bp, Homo sapiens
  misc_feature 5, 12, 33, 40, 42, 44, 45, 66, 76, 79, 83, 97: n = A,T,C or G
gtcgncactagnggattcaaagaattcggttcnagctcgngncnnattggggacgaggccacgggngtcctctggnganctgnagacatggccctangct

SEQ ID NO: 12095 - DNA, 111 bp, Homo sapiens
  misc_feature 5, 12, 70, 108: n = A,T,C or G
gcgcntgcaggnccacactagtggattcaaagaattcgtcacgagggcggacattcagactgagcgggcntaccaaaagtcagcacgaccatctttcaaaacaataanagg

SEQ ID NO: 12096 - DNA, 100 bp, Homo sapiens
  misc_feature 18, 21, 35, 37, 52, 57, 69, 75, 93, 94: n = A,T,C or G
agcaagcaacatgagtancangcctgtacacctgntncagggatgtagggangggcnaattggtgacancggganagtgggggagtgtgggcnngagagc

SEQ ID NO: 12097 - DNA, 100 bp, Homo sapiens
tactgtgttactgtgcctaacatatgttacattggggactcgaagaaccgtagaggaatgaggggaagagctggccatctgagcatccaaccccccagcc

SEQ ID NO: 12098 - DNA, 131 bp, Homo sapiens
  misc_feature 7, 16, 26, 28, 53, 62, 68, 69, 84, 87, 91, 96: n = A,T,C or G
agaccgnctgacttgngaacctgcgnancctggcctgccagcccatcagcttntcgggcttnggggcnnaggacgatgacctgngangccnggggntgggcccctgactcaaaaaagtggttttgaccaga

SEQ ID NO: 12099 - DNA, 128 bp, Homo sapiens
  misc_feature 6, 16, 31, 44, 71, 78, 89, 91, 93, 100, 101, 111: n = A,T,C or G
tcgtgntccatcctgnacacctggctatgcnttttagatagcangagaaaattagagaaagaactaaaagnctctganatgcagaaatnangnagtaagnnggctagtctntctccctctctctctgc

SEQ ID NO: 12100 - DNA, 109 bp, Homo sapiens
  misc_feature 5, 18, 28, 34, 36, 39, 43, 50, 52, 53, 59, 68, 69, 73, 79,80, 81, 93, 97, 99, 102: n = A,T,C or G
tcganctttgagaaagtnagaaagcaanagtgcnanaangctngaagacnannagtggnggggtatcnngaanataatnnnataagcttttgngtcntngcnttatgga

SEQ ID NO: 12101 - DNA, 100 bp, Homo sapiens
  misc_feature 8, 10, 21, 28, 29, 38, 41, 43, 50, 87: n = A,T,C or G
gctgaagncntgatggcgtgntaacttnnccacttaanacnangcatatntgaatatacaaagacacactgacggctccctggcagnctggatagaggcg

SEQ ID NO: 12102 - DNA, 103 bp, Homo sapiens
ggcgcttgcaggtcgacactagtggattcaaagaattcgttacgaggtttgacggcttgccgccgccctacgacaagtaaaaagcggatggggggtcctgctg

SEQ ID NO: 12103 - DNA, 100 bp, Homo sapiens
  misc_feature 6, 21: n = A,T,C or G
agttgngtgccgttggaccgnaggaaaactcatagactcatgggagcgtgaggcttcgagccgcctaattttttaaccctaaatgtcgaaaggcttctgg

SEQ ID NO: 12104 - DNA, 102 bp, Homo sapiens
  misc_feature 5, 11, 27, 32, 36, 44: n = A,T,C or G
taggncactanaggatccaaagtaatncggtncganccttaccnccgaccaccatgccttcaattaagttgcggaggtctgatgttgagatatttgaaggtg

SEQ ID NO: 12105 - DNA, 100 bp, Homo sapiens
  misc_feature 6, 8, 30, 34, 39, 45, 47, 91: n = A,T,C or G
aaaaancnaaattctggagcttgcgcgccngcantaggncactanangaattcaagaaataccggaccaacgtctggagctgtggctgttntgcttgtgg

SEQ ID NO: 12106 - DNA, 103 bp, Homo sapiens
  misc_feature 1, 3, 49, 50, 71, 74, 87, 92, 96, 98: n = A,T,C or G
ncnacactagtggattcaaagaattctttacgagcatgcctgtattctnngcactttgagagtccgagganagnaggatcacttgangcctngagntngaaac

SEQ ID NO: 12107 - DNA, 100 bp, Homo sapiens
  misc_feature 7, 17, 32, 36, 49, 59, 92, 96, 99: n = A,T,C or G
aaaaagnccaaatttcnggagcttgcgcgccngcantagggcactaaangaattcaaanaatagggctcgaggtcttcgcctgcgggcacgnaggncanc

SEQ ID NO: 12108 - DNA, 100 bp, Homo sapiens
  misc_feature 6, 7, 8, 23: n = A,T,C or G
ctttgnnnaggactccccaaacnacggggacactggggataccatctcatcatttgtgcttaaggaaaggagcaaagcgttccatggcgtcttaccggct

SEQ ID NO: 12109 - DNA, 113 bp, Homo sapiens
  misc_feature 2, 11, 18, 23, 30, 35, 36, 45, 69, 75, 84, 86, 93, 104: n = A,T,C or G
gnttcaggctngtgctangctancgccgtngccgnntcccttcantcgtcatcatgattatctaccggnacctcntcacccacnangagatgntctccgacatntacaaaatc

SEQ ID NO: 12110 - DNA, 110 bp, Homo sapiens
  misc_feature 1, 9, 39, 55, 57, 58, 90, 94: n = A,T,C or G
ngcttgcgngtcccactagtggattcaaagaattcggtncgagctagatacaatntnnagcgtgggaaacattgatatatatctactaanggantaaaaacatttatgag

SEQ ID NO: 12111 - DNA, 105 bp, Homo sapiens
  misc_feature 6, 19, 59: n = A,T,C or G
aatagnggacgagaggggnaaagccctcttcgacctttggtaatctgctaagctctaangctctggtcgagtagccccgggcgttccggagatccgcaaaacgga

SEQ ID NO: 12112 - DNA, 100 bp, Homo sapiens
cacttctggtgccctggagtgtcccattggatcattcacgaggggcctatgggagaatggaaccaaggaaaacactcatgctaccagcctgagacgcggc

SEQ ID NO: 12113 - DNA, 101 bp, Homo sapiens
ggttcatttgaccttttaagtttaagactgaaagactggttcatggcaacaatgcatcttaaaaccttcagaaggaagggagaaggtccagtgggccactt

SEQ ID NO: 12114 - DNA, 162 bp, Homo sapiens
  misc_feature 4, 20, 37, 39, 56, 65, 90, 115, 121, 132, 152: n = A,T,C or G
cgcntgcaggtcccactagnggattcaaagaattcgntncgagcttttcaaggaangagggaggnaggagattgaaatgctacggcccanaaaaaggagctgccttaaaagctgnattctntctggagcctncagaaggaaccaacctttgnaacatcttga

SEQ ID NO: 12115 - DNA, 100 bp, Homo sapiens
  misc_feature 7, 16, 30, 39, 45, 51, 68, 76, 79, 80: n = A,T,C or G
caagccntttgaggancacgtggaggaagnacaccctgncctatngggacntgagcactgggaaggtnactggggnatnnagacccataatcgacaaaac

SEQ ID NO: 12116 - DNA, 104 bp, Homo sapiens
  misc_feature 18, 26, 43, 46, 50, 72, 79, 81, 95: n = A,T,C or G
acactgttgcattatgcnaggacggnggcttttggaccctagnacnctancccaatcagccaagtgtgtttntggggangnggggaggaggggangatatccgg

SEQ ID NO: 12117 - DNA, 100 bp, Homo sapiens
  misc_feature 9, 18, 27, 48: n = A,T,C or G
cggctcagncggagacgncgccgtaangcgctacgtacctgccgaccngctgagtgccctagggggcaacctactgccccagcgccaaggacaacaagga

SEQ ID NO: 12118 - DNA, 162 bp, Homo sapiens
  misc_feature 6, 12, 74, 80, 91, 98, 128, 139, 145: n = A,T,C or G
catggntgggtngaagaagagagacaaaaagaacaaaactaagaagaccaaagcagcagcaggcaggcagcagnagcagnacctgccgcantgccagncagcagcaacaacagcagcaacaacagcancaacagcgggncagtanagggcatacatttcctg

SEQ ID NO: 12119 - DNA, 103 bp, Homo sapiens
  misc_feature 3, 22, 27, 39, 51, 75, 79, 86, 89, 91, 98, 101: n = A,T,C or G
cgnaagggcacctttgcccatntgagngaactgcactgngacaagctgacnggggatcctgagaacttcaagctnctgngaaatgngcngntgaccgnttngg

SEQ ID NO: 12120 - DNA, 100 bp, Homo sapiens
  misc_feature 2: n = A,T,C or G
gnagcgctgaatccctggagaaggggcgtgctgactagattcaaaggaggaaagggaatgaatgtctaagccaaggggccagcttgaatgccttcccaga

SEQ ID NO: 12121 - DNA, 102 bp, Homo sapiens
ggcctgaagggaaacatagataccaatgataacctggcaccgatgtacaaatatcagaaataacatccttcgtgccactctgtgcctatatgccaacgtgat

SEQ ID NO: 12122 - DNA, 197 bp, Homo sapiens
  misc_feature 21, 22, 28, 45, 64, 82, 83, 84, 100, 115, 117, 130, 179, 187: n = A,T,C or G
tggaacaaaaagccggagttnnggcgcntgcaggtcgccactagnggattcaaagaattcggtncgagagaacgtcggagannnaagccgatgaaggttntgaagaaggagctgngncacctgctgtccnagccactgtttacggggagccagaaaaccaagtatcccactcagtctgncaagccgnccctgcttgt

SEQ ID NO: 12123 - DNA, 109 bp, Homo sapiens
  misc_feature 80: n = A,T,C or G
tagatgggcggattattgacaccttcctgaccagagaccctgtggctatagaacttggccaaaagcaggtgattccaggnctggagcagagtcttctagacatgtgtgc

SEQ ID NO: 12124 - DNA, 100 bp, Homo sapiens
  misc_feature 3, 10, 50, 60, 63, 85, 87: n = A,T,C or G
ctncaccttnggggcttgtgtgcgcgcgtgcacagcatgagggggggagnggggcggagngcncaagagcataacctggtctctngntgtgggcctttta

SEQ ID NO: 12125 - DNA, 106 bp, Homo sapiens
  misc_feature 14, 22, 29, 46, 71: n = A,T,C or G
gggaacaaaaagcnggagtttngggcgcntgcaggtcgccactagnggattcaaagaattcggttcgaggncaccttcgtgaataccaagaacctgctcaatggta

SEQ ID NO: 12126 - DNA, 100 bp, Homo sapiens
  misc_feature 3, 16, 28, 29, 38, 40, 49, 67, 79, 81, 88, 92, 94: n = A,T,C or G
tanaggaattcaattnatacggtagganncttgtcaantnctccatctncccatcactctcaagagntccagaggccgngnggccggnggtncncaaata

SEQ ID NO: 12127 - DNA, 146 bp, Homo sapiens
  misc_feature 3, 17, 42, 55, 63, 66, 68, 73, 120, 123: n = A,T,C or G
cgngcgcctgcaggccnacactagtggattcaaagaattctncacgagccttgangaaccttnggngngtggngggaagctatcaaaacaagaaatgtaggcatttcccgtttttttggnggnggggggggggggggcagggctcc

SEQ ID NO: 12128 - DNA, 100 bp, Homo sapiens
  misc_feature 4, 15, 37, 41, 46, 49, 52, 57, 68, 79, 83, 85, 86, 87, 94,96, 99: n = A,T,C or G
tggnacaaaaacccnaatttctggagcttgcgcgccngcantaggncantanagganttcttttaatnccgcaccaacngcgngnnnacgatgngntgnt

SEQ ID NO: 12129 - DNA, 103 bp, Homo sapiens
  misc_feature 24, 65, 87, 94, 98, 99: n = A,T,C or G
cactagtggattcaaagaattcgnttcgagctccatcaccccttctgccctgtgaaagggagaanacaaacatccacgaaccacggnagtgggncctnnccag

SEQ ID NO: 12130 - DNA, 100 bp, Homo sapiens
  misc_feature 5, 55, 92: n = A,T,C or G
ctgantgagaggactataacacaagcacggaagcttggcacttttcaaatttccngatacctaatgacctactgacctactgtacagggatngatgtggg

SEQ ID NO: 12131 - DNA, 117 bp, Homo sapiens
  misc_feature 38: n = A,T,C or G
cgggccggagagggctaccatggggaaaatcgcgctgnacctcaaagccacgctggagaacatcaccaacctccggcccgtgggcgaggacttccgggtggtaccttgaaggacagt

SEQ ID NO: 12132 - DNA, 302 bp, Homo sapiens
  misc_feature 60: n = A,T,C or G
gcactttatatacgaggacttggtgaatttacccctctctaccctatgctatttggaggnggacaagaacggaatttcaggccagggacagagaacaccccaatgattgctggccttgggaaggtgagccctggtgagcttgaggagatgagttgattgctttgtcatcagtgtccccagcggctctagtaggaatctggggctttagggagatcatattcgtgatctcataagcggactgacaagaaaaagcctggaatctgatttatcaacctggagagctgtactttttcagatctgtg

SEQ ID NO: 12133 - DNA, 103 bp, Homo sapiens
acactagtggattcaaagaattcaacactaggactgaaggcctgggggagaaccaggcttgcactgtcgacactgtggaatggtaggagcaaaaacacccgaa

SEQ ID NO: 12134 - DNA, 111 bp, Homo sapiens
  misc_feature 79: n = A,T,C or G
aaaggctggaagcttcgggcgcttgcgcgccggcactaggggactcaaggaatctcgggacgagggttcaaagcagtanagcacaaagtccacctggtcttgtgcccccga

SEQ ID NO: 12135 - DNA, 104 bp, Homo sapiens
  misc_feature 42: n = A,T,C or G
ggctggagctcgggcgcttgcgggccggcactagtggattcnaggaattcgggacgagggcattaaggctgtgagctcggaattactttaaaaggaggtaacgg

SEQ ID NO: 12136 - DNA, 339 bp, Homo sapiens
cctaactggaatggggtacattaccatttcctgaggtgctttttcaccagctttttcctcccttcaccatttgtgtttaagagccttcaccgggcgtggtggctcacgcctgtaatcccagcactttgggaggccaaggcgggcggatcacgaggtgaagagatggagaccatcctggccaacatggtgaaaccctgtctctactaaaaatacaaaaattagctgcgtgtggtggtgaacgcctgtagtcccagctactcgggaggctaatgcaggagactgtcattaacccgggaggcggaggttgcagtaagcagagattgcgccactgcactccag

SEQ ID NO: 12137 - DNA, 100 bp, Homo sapiens
ctggcgcttgcacgcccacactagtggattcaaagaattcgtcacgaggcaacatggcagaaggacagcagaagaagaaacgaaccttccgcactttcac

SEQ ID NO: 12138 - DNA, 310 bp, Homo sapiens
  misc_feature 259, 290: n = A,T,C or G
tggcacccttggcaggagtgtggctggagggctataaaagaggagtgtgataggattaatgttaattgctgtagcagcaattgcagcaggcatgatggagacccagcctgtgctgggtaaaatacatgtattaattcatttcactctcactgccctgtgaggtaagcacttttattaccccattttacagataaggaaatgaaggcattggcaaggctaaataaccagcctgtggtcacatagctcctgagtggcaganctcaactttgaacccaggtagcctgggctgnggagtctttaatcctaactg

SEQ ID NO: 12139 - DNA, 316 bp, Homo sapiens
ttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaat

SEQ ID NO: 12140 - DNA, 336 bp, Homo sapiens
  misc_feature 202: n = A,T,C or G
gaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgngcctgtaaaccaaggagttttccccgtttgtaaaaagacattgtagataattgaatgtttgattttagaaaggtcattagtttcttgttacacattttgttagtctggtttttgttgcttatcgggtttaatat

SEQ ID NO: 12141 - DNA, 329 bp, Homo sapiens
cacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctg

SEQ ID NO: 12142 - DNA, 383 bp, Homo sapiens
  misc_feature 2, 41, 43: n = A,T,C or G
gngcgcctgcaggtcgacactagtggatccaaagaattcgntncgagcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgagctgctgaggccccatcacgactgctgcaacgccaaggagcagcctgctg

SEQ ID NO: 12143 - DNA, 335 bp, Homo sapiens
ggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaactttacggcaagcctgtccatcatggtgttaaccagctaaagtttgctcgaagccttcagtccgttgcagaggagcgagctggacg

SEQ ID NO: 12144 - DNA, 330 bp, Homo sapiens
  misc_feature 12: n = A,T,C or G
gaaaagataaanggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgg

SEQ ID NO: 12145 - DNA, 352 bp, Homo sapiens
tcacttcacttttattatgaacaaacacaatctcagattagtacaattagcttcagagttgatattaatagaaattattccaaaattattcttgtcacaagtaactactatatcccacataaaaagggaaaaaatcccacccaatcacagaaaaggcatcctctgtatgtttccgtggcaatgcgttgtttatgtattctcaaattttgtctggctagttatccaccgcttctccaatggattcattcagtttcttggagaaccatatagactaatgacagcatctgggacacacggacgtatcaagttcatgggggacattcctattataaaaaatactcaggtcttgaga

SEQ ID NO: 12146 - DNA, 270 bp, Homo sapiens
  misc_feature 76, 137: n = A,T,C or G
gtcctgcggggcatggggggcgccttcgtgctggtcctgtacgacgagctcaagaaggtgatctaagggccgcggnctcctccacacacacacacacaccaggggaaccaagagaaccacgtagaatcctcaaccgngcggaccatcaaccttcgagaaattccagttgtctttttcccagccgcatcctgcctgtagatggccggggaaggctctagaaaaggggcgcattgcgatccaaccatcggcagccgattccgtgtcttgatc

SEQ ID NO: 12147 - DNA, 297 bp, Homo sapiens
  misc_feature 15, 19, 174, 207, 227: n = A,T,C or G
gacccaggccctgcnagcnatggcagaaatggccgagacggtgagcgaggccccccaggggtggcaggaattcctggagtgcctggacccccgggacctcctgggcttcccggtttctgtgagccagcctcctgcaccatgcaggcttggtcagcgagcatttaacaaagggcntgacccttgaaaggcttactgctgcatggctgnctgcatgaaccacgcctggngaaggagcctgggtgagaaacaccatccaaagctgggcaaaagatgattaccttcagcatgattacaatg

SEQ ID NO: 12148 - DNA, 192 bp, Homo sapiens
gtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttaca

SEQ ID NO: 12149 - DNA, 344 bp, Homo sapiens
  misc_feature 128: n = A,T,C or G
agccgcatcttctggcggaccgtgcgaggtatgctgccccacaaaaccaagcgaggccaggccgctctggaccgtctcaaggtgtttgacggcatcccaccgccctacgacaagaaaaagcggatggnggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaaacagctcatgaggctacggaaacaggccgagaagaacgtggagaagaaaattgaca

SEQ ID NO: 12150 - DNA, 340 bp, Homo sapiens
  misc_feature 302, 311: n = A,T,C or G
attttgagtttagctggaaacttctgtaaggggcagcagttgaggtggggtagtgccgcagtggggtcaagctgagctggcttcggagatggagtcccttttcattctcctcctcctccctcctcactccctaggcccaagtctcctaggggcttggtcctagggtgggaaggggctagggaggaccaaagggatggtattgagaagagagaaagaagatagtgagatttaagttcctgctgcctgggtaggccccacaaggcctggtctgggagtatacggaaacaaaaatgatcctcagngcaaaatgncttgtgtatttctctgtgaatccatgggt

SEQ ID NO: 12151 - DNA, 109 bp, Homo sapiens
agtacttctagagcggccgcgggcccatcgattttccacccgggtggggtaccaaggtaagtgtacccaattcgccctatagtgagtcgtattacaattcactggccgg

SEQ ID NO: 12152 - DNA, 274 bp, Homo sapiens
  misc_feature 79: n = A,T,C or G
gctggacaaggtcctgctggccgtctctgaggagtacctcgacctccgcctgaccttcggaccctattccccctctggnggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagc

SEQ ID NO: 12153 - DNA, 313 bp, Homo sapiens
  misc_feature 14, 18, 43: n = A,T,C or G
tgggcgcctgcagnaacnccactagtggatccaaagaattcgnttcgagctttctctccctcagcctgccagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaac

SEQ ID NO: 12154 - DNA, 345 bp, Homo sapiens
  misc_feature 20: n = A,T,C or G
cccctccccccgagcgccgntccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtt

SEQ ID NO: 12155 - DNA, 342 bp, Homo sapiens
  misc_feature 218, 242, 250, 288, 329, 338: n = A,T,C or G
gttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacnaggagggcatgtatgctgactggnggcagganccggatgccaagggtgacgaggccgaggcttgacccanaaccttgaactcgcatgaaaaggggacaccccacacccttnaagcttggnaagc

SEQ ID NO: 12156 - DNA, 307 bp, Homo sapiens
  misc_feature 1, 5, 8, 10, 111, 220, 247, 261, 280: n = A,T,C or G
ngctnatngncccagtcactgggaaaatgcaaatcaaaaccacaagcatgccactgttgtacccattaagatggctgccatcaaaaaaccccagaaaactgcaagtgttgntgagagtgtggagaaattggaacccttgtgcaccgttggtgggaacgttaaatggcgcagctactatggaaaacggtatgatgattcctcaaaaaattaaaaatagaantacaatatggcccagcaatcccacctntgagtatacacccnaaagaattgaaatcagggnctcaaagagatgttggtacaaccatgt

SEQ ID NO: 12157 - DNA, 278 bp, Homo sapiens
ctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgttttt

SEQ ID NO: 12158 - DNA, 398 bp, Homo sapiens
  misc_feature 14, 30, 57: n = A,T,C or G
aaaagctggagttngcgcgcctgcaggtcnacactagtggatccaaagaattcggtncgagcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccc

SEQ ID NO: 12159 - DNA, 139 bp, Homo sapiens
  misc_feature 15, 28, 48, 52, 55, 56, 60, 75, 83, 89, 91, 92, 102, 116: n = A,T,C or G
ggggggggggccttnggaaatttttttntaaaggggctttttaaaaangggnggnngagnggggggggggttccnaccccaanccccgntnntaattttttncaccctttttttcnaccttgcctttgggtttttaaag

SEQ ID NO: 12160 - DNA, 131 bp, Homo sapiens
  misc_feature 70, 103: n = A,T,C or G
caaacaccacctcccttattcaggaccggcacttcttaatgtttgtggctttctctccagcctctcttangaggggtaatggggggagttgggcattcttggnaacctctccttttctccttttctttccc

SEQ ID NO: 12161 - DNA, 265 bp, Homo sapiens
cctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcattgggttgagtgtggccacctgcaggatgtgcagggctgcctcagaagctggctggggactctagcctctgtgttcataaagacattaagaagtggatggatgttgttccttttttg

SEQ ID NO: 12162 - DNA, 354 bp, Homo sapiens
  misc_feature 7, 11, 38, 165, 184: n = A,T,C or G
cggcacnaganaaactagtttatctttttctttgcttngaaaaatacaaaccatggtattacaaaaagcaatactgagtattcatatatctaaatgttttaactcagcttagatgatcatcccatccttgattctttgtcttcaaactttctcaaagattctggnatcaggatgttaggacagncatgcattgaatgattttacctggctttttgaaagaattaaaaatataaagaagctaagtaagtaggatatgccactcctttaccatacttctgggtatcaaactgaaggggaatccacctcttatgtacagcaaggccatatatccacacagaggtttgcaggtgagag

SEQ ID NO: 12163 - DNA, 337 bp, Homo sapiens
gaaaacttgatactacttaggttggatgatctcctaggtataggatagagaaaaaaaaatcaaaggtatgtagtatgtattgccatctgtgtttaaaaataaaagagcatatggggaaactgtatatgcatgtgctttatctaaacctaatgtatttctgaaaggaggtctaagaaactgctaagatcaaacttccagggagaggaattcaatggctggaaaaggaaggtgggagatgtttgggtctatccttgttttgtacgttttgaatattgaaacatatgactgtattacctattttaaaaattaaagaatacagttacagtttggaaataac

SEQ ID NO: 12164 - DNA, 337 bp, Homo sapiens
gttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaag

SEQ ID NO: 12165 - DNA, 328 bp, Homo sapiens
  misc_feature 82, 85, 181, 268, 274: n = A,T,C or G
ttcggcacgagcgagttttttttttgctgtaggcccgggtggttgctgccgaaatgggcaagttcatgaaacctgggaaggnggngcttgtcctggctggacgctactccggacgcaaagctgtcatcgtgaagaacattgatgatggcacctcagatcgcccctacagccatgctctggnggctggaattgaccgctacccccgcaaagtgacagctgccatgggcaagaagaagatcgccaagagatcaaagataaaatcttttgngaaagngtataactacaatcacctaatgcccacaaggtactctggggatatccccttgga

SEQ ID NO: 12166 - DNA, 334 bp, Homo sapiens
  misc_feature 328: n = A,T,C or G
cccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagcttgctgccacagccagtattgccggggcttccaacccagtacccacctggccgggggggtcctcccccacctatgggccgaggagcaccccctccaggcatgatgggcccacctcctggtatgagacctcctatgggtcccccaatggggatccccctggaagagggactcnatggca

SEQ ID NO: 12167 - DNA, 336 bp, Homo sapiens
gccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggca

SEQ ID NO: 12168 - DNA, 332 bp, Homo sapiens
ctaaaaggagaacttgaaagttcggaccaggtgagggagcacacgttgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacattagcctggggccccagcttcctccccagaggcgcccccagcccgagcaggaccccgttcagctgaagacgca

SEQ ID NO: 12169 - DNA, 337 bp, Homo sapiens
gtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaagg

SEQ ID NO: 12170 - DNA, 338 bp, Homo sapiens
aaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgt

SEQ ID NO: 12171 - DNA, 334 bp, Homo sapiens
gtaatgcattagtgtggtaaaagacacttctactaactccatgacagcttacaaatgccatggcaatgtccagaagttaccctatatggtctaaaaggagaacctatatagtctaaaagaactgagggttctgagaaatccctgaccctttcctggaaaatttatgaataatccactccttgtttagcatacaatcaagaaataaccatagtgtactcagtcaagcagtccctgctgctgctctgcctatggagtagccattcttttgttctttactttcttaataaacttgctttcattttactttatggacttgccctcaattctttcttgt

SEQ ID NO: 12172 - DNA, 311 bp, Homo sapiens
  misc_feature 266, 271, 289, 305: n = A,T,C or G
ccatttcacataggtctatctgctaaatactttgctcagcatagtgagtgtcagttaaaaccacagaggggctttccacttagcttcaggcacaccctgggaaccacagcttttgtggacttcacaaattgaaaactagtcttgacaatgagcatcattttcactaaaactgatcgctggcatgtgtacctgcatacagaaaataggcttaatataaataaccaaccacaacaccacgtggagatgcacaggcttgtgaaagcttncaggngccctttaaaatactggngacttactgaaaaacnccactg

SEQ ID NO: 12173 - DNA, 196 bp, Homo sapiens
tggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcattggaagccattccgcagggccagc

SEQ ID NO: 12174 - DNA, 341 bp, Homo sapiens
  misc_feature 330: n = A,T,C or G
ttcggcacgaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagnttgactggaga

SEQ ID NO: 12175 - DNA, 351 bp, Homo sapiens
  misc_feature 6: n = A,T,C or G
cctggngctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacac

SEQ ID NO: 12176 - DNA, 327 bp, Homo sapiens
aaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctgg

SEQ ID NO: 12177 - DNA, 328 bp, Homo sapiens
agcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccag

SEQ ID NO: 12178 - DNA, 115 bp, Homo sapiens
gcgaaggatatcggtttcattaagttggactaaatgctcttccttcagaggattatccggggcatctactcaatgaaaaaccatgataattctttgtatataaaataaacatttg

SEQ ID NO: 12179 - DNA, 337 bp, Homo sapiens
gaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttcta

SEQ ID NO: 12180 - DNA, 210 bp, Homo sapiens
gtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttt

SEQ ID NO: 12181 - DNA, 184 bp, Homo sapiens
ctgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagt

SEQ ID NO: 12182 - DNA, 266 bp, Homo sapiens
  misc_feature 263: n = A,T,C or G
tagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaatttnaag

SEQ ID NO: 12183 - DNA, 324 bp, Homo sapiens
ggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcacttgtatgcctctgagcagagagcagcagcagcaggtaccagcacg

SEQ ID NO: 12184 - DNA, 319 bp, Homo sapiens
  misc_feature 172: n = A,T,C or G
ttcagtatttgtagtatgtggtgtttgtcatttatagtaacacatatgagaactacgagatgagacagtaaagggagctatgttgtggtaaaatttctacatttaacttgaagtggtagaaaaaaactctgattgtgaaaagtatgtattttgtaatccccatagtaagggntagtaaaccatattccacaggccaaatccagcccactgcctgtttttgtaaatacagttttgttggactgtagttacacctcattcattgcatatcatgtatggttgcttttgcactacagcatcagatttgggtgttgcaacacac

SEQ ID NO: 12185 - DNA, 103 bp, Homo sapiens
  misc_feature 90: n = A,T,C or G
cattttgcaaagcatatctttctaatgattttattgaatgactttcaaaaatactacattaagcagttgataaacacatattatataaanccaaaaaggcagc

SEQ ID NO: 12186 - DNA, 104 bp, Homo sapiens
  misc_feature 20: n = A,T,C or G
agtacttctagagcggccgngggcccatcgattttccacccgggtggggtaccaggtaagtgtacccaattcgccctatagtgagtcgtattacaatttcactg

SEQ ID NO: 12187 - DNA, 352 bp, Homo sapiens
  misc_feature 333: n = A,T,C or G
ccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtanttaaggactatggcaagga

SEQ ID NO: 12188 - DNA, 355 bp, Homo sapiens
gttttattgtggctaggaagttcaggtctgacttgccttcttttagcggacagggtctggacactaggcctgtgcttgtcctggaactagagaaatttaatggctgcaaaaagaaaatcaaggaaagagctctgagctctacacaaagcagaggtttctatacaaagtggtggtttctatgcaaagtgcaggttttctttcacaccgcctgtacaggggtagctactgctgcttttaatgcaatttagattttgtataactgaggatctgatatatctctttcttgtgccattggctactaagactttcatttattcattcattcatttattattcactcatttgtccattcttt

SEQ ID NO: 12189 - DNA, 174 bp, Homo sapiens
gagtcaactccgcaatcagatgttacagaggatggtgagagccctgaggatccctcagggacagagggtcagctgtccgaggaggagaaaccagatcagcagcccctgagcggagaagaggagctagagcctgaggccagtgatggttcaggctcctgggaagatgcagctttg

SEQ ID NO: 12190 - DNA, 328 bp, Homo sapiens
ccagattgcagggtgatttcaggacaccaagaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggt

SEQ ID NO: 12191 - DNA, 322 bp, Homo sapiens
tttgagaccaatttaatttcatttataagaacatagtaattaagtgaactaagcattcattgttttattaatactttttttctaaaataaaacttgtacaccagtttattactctaaaaagagaattacacatgccaaatggaccaatgtccatttgcttattggaggcaaagctacaatagaagtcagagcatcaccagaatggtctttaatgagcatggaacctgagcaaagggaataggtgggatgaattttttttttaattgtgaaacaattcataagcacaatatgatttacagaataataaacattcatgtaccca

SEQ ID NO: 12192 - DNA, 306 bp, Homo sapiens
gcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattca

SEQ ID NO: 12193 - DNA, 323 bp, Homo sapiens
  misc_feature 129: n = A,T,C or G
caactccacattcaaccaggttgtgttgaagaggttgtttatgagtcgcaccaaccggccgcctctgtccctttcccggatgatccggaagatgaagcttcctggccgggaaaacaagacggccgtggntgtggggaccataactgatgatgtgcgggttcaggaggtacccaaactgaaggtatgtgcactgcgcgtgaccagccgggcccgcagccgcatcctcatggcagggggcaagatcctcactttcgaccagctggccctggactcccctaagggctgtggcacttgtcctgctctccggtcctcgcaagggccga

SEQ ID NO: 12194 - DNA, 335 bp, Homo sapiens
tctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgt

SEQ ID NO: 12195 - DNA, 116 bp, Homo sapiens
cacacctgtaatcccagctactcaggaggctgaagcaggagaatggcgtgaacccaggaggcagagcttgcagtgagccgagattgcaccactgcactccagcctgggcgacagag

SEQ ID NO: 12196 - DNA, 260 bp, Homo sapiens
  misc_feature 25, 207: n = A,T,C or G
acactagtggatccaaaaaattcgntacgaggcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgcngtattagctagtggagccactttctgtattgttacatggacatatgtagcaac

SEQ ID NO: 12197 - DNA, 311 bp, Homo sapiens
tactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttg

SEQ ID NO: 12198 - DNA, 225 bp, Homo sapiens
  misc_feature 165, 168: n = A,T,C or G
ctcacacctcaaatctcaactactgggaagactgaggcaggaggatccttgagcccaggagttggctgggcagtcagctatgattgcgccaccggacttcagcctgtgcaacagagctagaccctatctctaaaaaataaaaataatttttttaaaattaggagnttncgaaatagagcctactatttagtttaaataatataattggaatttaaccacgacaca

SEQ ID NO: 12199 - DNA, 279 bp, Homo sapiens
ttcggcacgagctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtaggttttttttt

SEQ ID NO: 12200 - DNA, 357 bp, Homo sapiens
acccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttca

SEQ ID NO: 12201 - DNA, 327 bp, Homo sapiens
  misc_feature 307: n = A,T,C or G
ccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaagnaagaggtgctagctgctgcc

SEQ ID NO: 12202 - DNA, 330 bp, Homo sapiens
cgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcat

SEQ ID NO: 12203 - DNA, 330 bp, Homo sapiens
cggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgt

SEQ ID NO: 12204 - DNA, 247 bp, Homo sapiens
cggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgt

SEQ ID NO: 12205 - DNA, 235 bp, Homo sapiens
gtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaagga

SEQ ID NO: 12206 - DNA, 338 bp, Homo sapiens
  misc_feature 3, 52: n = A,T,C or G
acntcaccaattttctcgatttaaaaaactgtcaagagatttatttttccanttgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctggggggattgatacgaccggggaaaatgt

SEQ ID NO: 12207 - DNA, 343 bp, Homo sapiens
atttgctgctctgcagtatttgctgttctgtagcctctgctggtgatatccaggcaaacagggtctggagtggacctccagcaaactccaatagacctgcagctgagggacctgactcttagaacgaaaactaacaaatagaaaggaatagcatcaacattaacaaaaaggacatccacaccaaaaccccatctgtagctcaccaacatcaaagaccaaaggtagataaaaccacaaagatagggagaaaccagagcagaaaagatgaaaattctaaaaaccagagtgctccttctcctccaaaggattgcagctcctcaccagcaatggaacaaagaatgac

SEQ ID NO: 12208 - DNA, 324 bp, Homo sapiens
gcacctggcagaaaattcttaagcactctgagcttgaggtatggttgtctcagggtttcaaatggaatatctccggtcccaagaacacctcaaggagagaagacctgaataaacatttcaaaggttttaaaaattacatcattttagaatctaaaggaaccttagaggtcgtctggttcacctctgcccattttattgatgaagaagctgaggcccagagaagccatagaactttatgaagttctgtatttaatggcaaaactgggtctataagctaactttcccaagtgctgacctgatctaatatagctatagagtaccttc

SEQ ID NO: 12209 - DNA, 327 bp, Homo sapiens
  misc_feature 310: n = A,T,C or G
gccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctacctttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggngcgatcgggctactaca

SEQ ID NO: 12210 - DNA, 329 bp, Homo sapiens
gggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctagggggggtcagccagccctcttctgacactaaaacacctcagctgcctccccagc

SEQ ID NO: 12211 - DNA, 211 bp, Homo sapiens
ctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagat

SEQ ID NO: 12212 - DNA, 335 bp, Homo sapiens
  misc_feature 139, 285: n = A,T,C or G
tttcctacttttccttccctcaaagcttccattccacatccggaggagaagaaggaaatgaatttctctacagatgtcccattttcagactgctttaaaaaaaatccttctaatctgctatgcttgaatgccacgcggnacaaaggaaaaagtatcatggaaatattatgcaaattcccagatttgaagacaaaaatactctaattctaaccagagcaagcttttttattttttatacaggggaatattttattcaaggtaaaattctaaataaaatataattgntttttatcttttctacagcaaatttataattttaagattccttttcttgt

SEQ ID NO: 12213 - DNA, 335 bp, Homo sapiens
ggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagt

SEQ ID NO: 12214 - DNA, 334 bp, Homo sapiens
tgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaaggtgtgcatcaccttcgaccaggccaac

SEQ ID NO: 12215 - DNA, 393 bp, Homo sapiens
gttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatct

SEQ ID NO: 12216 - DNA, 352 bp, Homo sapiens
cggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtg

SEQ ID NO: 12217 - DNA, 323 bp, Homo sapiens
ctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagt

SEQ ID NO: 12218 - DNA, 123 bp, Homo sapiens
  misc_feature 41, 120: n = A,T,C or G
ctgaggtaggaagacctgtctactcttggtttcaccactanaacagtcttgggctggatgggttatagagctgagcggctgtgatggttctgtttttacattaacaaaaacaattaaaancac

SEQ ID NO: 12219 - DNA, 323 bp, Homo sapiens
  misc_feature 55, 231, 295, 303, 316: n = A,T,C or G
acctggggcggaaaaaggcaaaagtggatgagtttccgctttgtggccacatggngtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgancttggtctgggccttttaaggcagttggagtctctacattattaggcttgcattattttatcanagcttagnaggtggccccagngactcag

SEQ ID NO: 12220 - DNA, 325 bp, Homo sapiens
  misc_feature 122, 204, 239: n = A,T,C or G
cggagatcacgttttgatagaccacctgcccgacgtccctttgatccaaatgatagatgctatgagtgtggcgaaaagggacattatgcttatgattgtcatcgttacagccggcgaagaanaagcaggtatttattttaataaaggaatggttggtattctagttaatcaagtaattcttttattagcaaggcagaaactagngtttttctataaacttgaatgttaattgtacaggngtattttacaatttttgtttaattaaaaaaatgttactatattaataatcaacctggtcaaaacctttcaggtttcttcgtttgag

SEQ ID NO: 12221 - DNA, 279 bp, Homo sapiens
gtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatgg

SEQ ID NO: 12222 - DNA, 295 bp, Homo sapiens
  misc_feature 58: n = A,T,C or G
cagcaacgtggtcttggacacaaccatgcggggtggccgcctgggggtcttctgcttntcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgaggggggaagtgaagaagggctcagagaggacaaaataaagtgtgtgtgcagggg

SEQ ID NO: 12223 - DNA, 209 bp, Homo sapiens
ctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaac

SEQ ID NO: 12224 - DNA, 327 bp, Homo sapiens
  misc_feature 15, 25, 50, 51, 167, 201, 264, 271: n = A,T,C or G
acatagatgtaagtntattaattcntaactttttaaaactcactgattgnntttaaggatgctaggaagctattactaattgttttgaaaattagtaaataaaagtaaaaaattactcatttattctgtcctttctatacagactgcatcaggacaactgaatagtngatgagttttttttatagaatttttccagctagngaataaagaaagaatgatagactatcatgtgatcgtttttcaaccccgttaatggattgcttnagttggngatcattgataactgttaatatcaaaaaaagggaattcaatagacttttgaactta

SEQ ID NO: 12225 - DNA, 100 bp, Homo sapiens
  misc_feature 3, 6, 9, 25, 41: n = A,T,C or G
gcnttnggnggagcaacaatgtggnactatacgattcctanttctaaaaataaaattgaagatccttccagttcttggatttctaggtggagtaatattt

SEQ ID NO: 12226 - DNA, 156 bp, Homo sapiens
  misc_feature 7, 50, 53, 92, 108: n = A,T,C or G
gaacggngagcgtagggaccatcatgagcctcctcaacaagcccaagagnganatgaccccagaggagctgcagaagcgagaggaggaggantttaacaccggtccantttttgtgctcacacagtcagtcaagaacaatacccaagtgctcatca

SEQ ID NO: 12227 - DNA, 155 bp, Homo sapiens
  misc_feature 4, 33, 42, 57, 65, 75, 154: n = A,T,C or G
cggncccagaaggaaaccagggtgacagagganacaaaggcncggcaggagcagggntggacggncctgaagganaccaggggccccaaggaccccaaggcgtgcccggcaccagcaaggacggccaggacggtgcttcccggcgagccctggnc

SEQ ID NO: 12228 - DNA, 109 bp, Homo sapiens
  misc_feature 3, 20, 65, 72, 96, 108: n = A,T,C or G
ggngagtcaggatgattccnttctccgattggccaaggccgatggcttcgtctcaaagaactttngactggngagaatcacagatgtggaatattngtcataaataant

SEQ ID NO: 12229 - DNA, 359 bp, Homo sapiens
  misc_feature 33, 42, 45, 70, 94, 97, 114, 270, 298, 354: n = A,T,C or G
ccgaaagatttaaactactggtacaaatatttnaatcttatnggntcgggtttaaactaaaaatatcctnttcctgcacaccaacaaaaactgnaanaaaatatggattgagtnccagtatctagagtttgttttaatatgtgggggagaggaaatatactatgttaatttcaagcgtaaaaatagggctgcaagtaaacagatatgttccttgaaatgtaaaatttcgcccgtcactgatttcaggctttttcaaactgctgatgctgngtacaggagggggaggaggaaaggttcnagacctttgaaggacatcgggtagcgctgtaacctgaggggccgccttggttttgngggtg

SEQ ID NO: 12230 - DNA, 196 bp, Homo sapiens
  misc_feature 7, 10, 63, 107, 110, 142, 155, 157, 184, 187, 192: n = A,T,C or G
cccaatnggnccaatctatcaccctatagaagaactaatgttagtttaagtaacatgaaaacnttctcctccgcataagcctgcgtcagattaaaacactgaactgncanttaacagcccaatatctacaatcaaccaacangtcattattaccntnactgtcaacccaacacaggcatgctcntanggaanggtt

SEQ ID NO: 12231 - DNA, 370 bp, Homo sapiens
  misc_feature 13, 78, 139, 144, 160, 170, 185, 205, 223, 234, 241, 249,256, 276, 279, 284, 313, 323, 327, 360, 368: n = A,T,C or G
ctttcagggaggnggttgcaaatttctaaggtacaattgctctattgagtcaccacgaaaaggctggagcttcatgcntcctgggagactcacacatttgcatgaaggacttcctgttaaaaatggaacaagatacatngcagngtcatttatagatccntaagttattnacttttcattgaatngaaatttattttgggtgaangactggcatgaacacgtntttgaagttgnggctganaagatganaggaatntttaaataacatcaacagancancttcnctttgggccaaacatttgaaaaacttttnataaaaaatngttngatattgcttaatgcctgctctgagccttaaancacagatnga

SEQ ID NO: 12232 - DNA, 120 bp, Homo sapiens
  misc_feature 7, 8, 52, 67, 91, 99, 103, 115: n = A,T,C or G
cagcttnnagggccgggagctcctggtcatcgagctgtccgacaaccctggngtccatgagcctggngagcctgaatttaaatacattggnaatatgcntggnaatgaggctgtnggacg

SEQ ID NO: 12233 - DNA, 254 bp, Homo sapiens
  misc_feature 7, 12, 16, 29, 47, 76, 91, 103, 122, 131, 198, 245: n = A,T,C or G
ggagggngcccntggnaacacagtgcccnagtggtgcgggccaggtntggcgccaggggcaggcagctaggcaggnagggggctgggaaanaacttggacttntaaaggcggagggtctccntgggcaccntgcaggcaggcagaccacagtgtggggggtgccccacaaggctcagccttgggcaaggaagctttgnaagcagcaaggtggggggtcaggctacaggtgccccaccttccccanagccctgag

SEQ ID NO: 12234 - DNA, 325 bp, Homo sapiens
  misc_feature 37, 64, 67, 130, 139, 169, 192, 212, 269: n = A,T,C or G
gaacacattatcttcaatccaagattttggagtcagngatggagttgagcgagtaaatttcggnggngctatgacattaccagaaaacggtttcttcaatggagatatctgattcatagttcctgggatncccatgttnccggttctacgatgatctctgccatgcatngctccccaggacatacttccagngccccagccactgctctganggttgctccagggagactgtttcagaagaggctagggaaaacatagctatttaaatngcggcatttaaagaatttacaattcaaattcaaattcaaatttcagacctaagaat

SEQ ID NO: 12235 - DNA, 224 bp, Homo sapiens
  misc_feature 9, 29, 69, 93, 116, 183: n = A,T,C or G
aaagagagngacttctcattgttatttgnggagaggctaattatagaagcttcattctttattttctgngttcttaaatttttttttacattngaaagtatgaaaatactattttngacactttactgatactcagggattaaaagttaaattttactgactgtagcagcaggtaaatctctnaaatttactcaggtttcctatcctttgcctccatatttaag

SEQ ID NO: 12236 - DNA, 319 bp, Homo sapiens
tggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaagaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacag

SEQ ID NO: 12237 - DNA, 328 bp, Homo sapiens
aaacaatgcataactctgatggaattgaagtcatgaggcagcagagagcttaaattagagctttaaaaatttttattttttagagggaatttaattgggagtaacagcagtaatagttaacggagccagaatgcttgagtcatataattgcaaagcagagttgggagcaacagatgctaaagagtagttgctgtagttcctctttgggtcgtaggagcagttgtcatgttactatacagctactgaatgaagaagagttcttagtgaggcctgggtgaacagctcttcttagtattctgtgtgaccccattcgaccttttaacaaatc

SEQ ID NO: 12238 - DNA, 296 bp, Homo sapiens
  misc_feature 87, 149: n = A,T,C or G
ccaacaccagcgctcacccgcatggagcagagccgcttcaaacgccaccagttgatcctgcctgcctttgagcatgagtaccgcagnggctcccagcacatctgcaagaaggaggaaatgcactacaaggccgtccacaacacggctgngctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccggga

SEQ ID NO: 12239 - DNA, 327 bp, Homo sapiens
  misc_feature 16, 34, 85, 237, 304: n = A,T,C or G
atggaaacaatgtttnagaaatgtttttcttggngtaatttaatgcagatttttacctcaattttgttaaaaaacttgataattngatccctccatctatttaatatttaatattttcagattctagagtatttaaaatttaaacacaattataaaattaattataattcctacttatgttagctatgatttagggccaaaactaccctggttttgtcttgcaacttgaaacattgngtattttaaactatataatttgggaacattattttatagactgtggataaccaaatataagatttgngatttttaatgcttcatttgtgt

SEQ ID NO: 12240 - DNA, 167 bp, Homo sapiens
  misc_feature 76: n = A,T,C or G
cccagtcggccctcagagcccttgcccgctcgggtatgaagatcgggcggattgaggatgtcacccccatcccctntgacagcactcgcaggaaggggggtcgccgtggtcgccgtctgtgaacaagattcctcaaaatattttctgttaataaattgccttcatgt

SEQ ID NO: 12241 - DNA, 157 bp, Homo sapiens
ccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattg

SEQ ID NO: 12242 - DNA, 209 bp, Homo sapiens
gaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttat

SEQ ID NO: 12243 - DNA, 324 bp, Homo sapiens
gtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggt

SEQ ID NO: 12244 - DNA, 247 bp, Homo sapiens
gctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcaga

SEQ ID NO: 12245 - DNA, 329 bp, Homo sapiens
gggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgccccctcgagtcgatggtgtcccgcatctactcatgtgaactg

SEQ ID NO: 12246 - DNA, 351 bp, Homo sapiens
agaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagc

SEQ ID NO: 12247 - DNA, 323 bp, Homo sapiens
  misc_feature 19: n = A,T,C or G
caattatccgccaactgcntttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagtt

SEQ ID NO: 12248 - DNA, 291 bp, Homo sapiens
caaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttg

SEQ ID NO: 12249 - DNA, 177 bp, Homo sapiens
  misc_feature 117, 176: n = A,T,C or G
tttcgcacggtccaataagggagggcggcgtggcccggcctggtagcgacgaggacgcgcctgcgcagaggcggcagcaccaccggggttgacttccgggggcgcggggaggagaanacatgaggctgagctggttccgggtcctgacagtactgtccatctgcctgagcgccggng

SEQ ID NO: 12250 - DNA, 327 bp, Homo sapiens
  misc_feature 237: n = A,T,C or G
gtaatagaaaatatgataaccacataatcagaaaccaaaagggacctcagaaattctagttcactttctccattgaatttccaaattgagttcaaaacaaactgtaatgcccaatactgcatagtaaattaataactttaaccccaaattaatttttaaaaactttactagacacgtgaatctcaatagggaaaatatgaaataagaacactacatactactgtgtccggaattggngggttcttggtctcactgacttcaagaatgaagccgcaccgcagaccctcccagtgagtgttacagttcttaaaggcagcgtgtcccgag

SEQ ID NO: 12251 - DNA, 298 bp, Homo sapiens
  misc_feature 297: n = A,T,C or G
catagctaaccgcacccggttcagctcgcctttcttggccagaggcgccggttggactcacgggcggggcatgatggtggtgggtaccgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataaatctggagaatcttgtctttggcaaaggattccaagcaaagatcttccctgana

SEQ ID NO: 12252 - DNA, 330 bp, Homo sapiens
  misc_feature 105: n = A,T,C or G
ctttaactttgtgtaaaatcttatagtattatcagcttagagggaattgatatttttaatattgccgttatattccaaaatatatattgagataaatgaactggngtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaattta

SEQ ID NO: 12253 - DNA, 262 bp, Homo sapiens
cgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgc

SEQ ID NO: 12254 - DNA, 319 bp, Homo sapiens
tgtaaatgagctagtaactgtcttgcggaataatgaatattaaatgagtaaagaaaagtgcttggtgcgtaaaagacataccaataaattttagtcatcgttgttacttgcaggactctaggaaatgtgtttgattctcgagatacagccctgagaattaggcattatttgtaaaatgagaacactgaagcccagagagatgatttgcccaagggtacctgtgtcagagccctgactccaacttagataaacctgattccgttttatgacttccagtacacagactattttctgagcacctcaaatccccataactgac

SEQ ID NO: 12255 - DNA, 282 bp, Homo sapiens
gccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccacccggcctcggctctttactccattcacagccgtgcacgcgctcaagccaccagggtgcgagatgccagctctggagttctcggttgttgtaggaggttgggtgttttcaaatggtaaagatgttttgagcaaat

SEQ ID NO: 12256 - DNA, 291 bp, Homo sapiens
ttcggcacgagagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccaagagccgcctgccatgccccagccagtccccacagcataacagggtctccttggcagctgtattctggagtctggatgttgctctctaaagacctttaataaaattttgtccaaagac

SEQ ID NO: 12257 - DNA, 295 bp, Homo sapiens
  misc_feature 43: n = A,T,C or G
cttgacgaggctgcggtgtctgctgctattctccgagcttcgnaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataacccccagctgtggtctctgagagactgaagattcgaggctcccctg

SEQ ID NO: 12258 - DNA, 244 bp, Homo sapiens
  misc_feature 145: n = A,T,C or G
ccaaacatatgaatgaaacaagccacacacagggctaaggataactaacatttcatccgatgacagtgggaagcagatctcttgtgtggcggaaaatcttgtaggagaagatcaagattctgtcaacctcactgtgcattttgcnccaactatcacatttctcgaatctccaacctcagaccaccactggtgcattccattcactgtgaaaggcaaccccaaaccagcgcttcagtggttctat

SEQ ID NO: 12259 - DNA, 309 bp, Homo sapiens
gccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagcctcttgcccatgattcagagctttcaaggataggctttattctgcaagcaatacaaataataaatctattctgctgagagatcac

SEQ ID NO: 12260 - DNA, 174 bp, Homo sapiens
gggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagg

SEQ ID NO: 12261 - DNA, 288 bp, Homo sapiens
ctcagaggtgggatgcaggatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttc

SEQ ID NO: 12262 - DNA, 329 bp, Homo sapiens
attttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtagggaattaatgtactcttgctttgtcaagctgtttgctatagtttccaaggtattatgttactctaactctgaaaagtgatgtaatctggtagcaatg

SEQ ID NO: 12263 - DNA, 260 bp, Homo sapiens
  misc_feature 94: n = A,T,C or G
aaaggtggtcatggcactaggagactacatgggcgcctcctgtcacgcctgtatcgggggcaccaacgtgcgtgctgaggtgcagaaactgcanatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctca

SEQ ID NO: 12264 - DNA, 204 bp, Homo sapiens
ttcggcacgagtgccgttcgggcctacccagcaggtaagtcttaggccatcgcctgcggtgtcggccccgggagcagcgagacccaagattgcatcaaacgtttgccccgtctctgcatatgtgactggacgtgaatgatgcttcatttttggcacccccctttccctgctcaggtagaatgtaaacaattgaaaaaaatccct

SEQ ID NO: 12265 - DNA, 127 bp, Homo sapiens
  misc_feature 31, 55, 69: n = A,T,C or G
tattgggatcatgcataatgcggggggggcntatttctggggtaatttaataagntttcttcctgtttnagaccaatataaatatccggctaagactaagcaaacaagaagactagctttttgaagc

SEQ ID NO: 12266 - DNA, 321 bp, Homo sapiens
cccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagtttggacttttctcccctctctttctaagagacctgaactgggcagactgcaaaataaaatctcggtgttctatttatttattgtcttcctgtaagaccttcgggtcaaggcagaggcaggaaactaactggtgtgagtc

SEQ ID NO: 12267 - DNA, 356 bp, Homo sapiens
tcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaaga

SEQ ID NO: 12268 - DNA, 146 bp, Homo sapiens
tgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 12269 - DNA, 221 bp, Homo sapiens
gtaacagcagaaatagtagtcaggagttcgagaacaggctggttaacatggtgaaaccccgtctctactaaaaatacaaaaattaactgggtatggtggcagatgccagtaatcccagttactgggaaggctgaagccagagaatcacttgaacctcagaggcagaggttgcaagtgagccgagatggcgccattgcactccagcctgcgcaacaagagcg

SEQ ID NO: 12270 - DNA, 100 bp, Homo sapiens
gtggattgtttgagcctaggagtttgaagctgtggtgagtgagccatgatcttgccactgcacaccagtctgggcaacagaatgagaccccgtctcttta

SEQ ID NO: 12271 - DNA, 328 bp, Homo sapiens
  misc_feature 305: n = A,T,C or G
gataatacatttgtgtctttctacatagtggtatagaaatatcaggtccccaaattcccatttttcttccaatcacatttaaaatttcaatatgttgcaggcagtatgtgtaagattatatccaaatatttactcctggttgctcctcttgggcaagcttgtgaatatgatcaaaatatttaaagaaggaagaaggtaaagatctaaaatatgacatgaaaatacccagagaagtgtgcctaaattagcattagggtttgagggatcctaaggatgacaaaaagggactcttctattgaattcgnggttgatgctcagcgatagtaac

SEQ ID NO: 12272 - DNA, 290 bp, Homo sapiens
ccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatccttc

SEQ ID NO: 12273 - DNA, 324 bp, Homo sapiens
ctacactagccctgttggataagagccctacactagccctgttggataagagccctacactagccctgttggataagagccctacactagccctgttggataagagccctacactagccctgttggataagagccttacactagccctgttggaaaggagccttacactagccctgttggataagagctttacactagccctgttgggtaaaagccatactcttaggacttcatgtaacctttattatcttttcataggccctatcttcaagtacaggcacagtaggggttagggatttaatgtatgaatttggggggcaggag

SEQ ID NO: 12274 - DNA, 352 bp, Homo sapiens
gtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaccatgtgctgtgtccactcaggggtcaatggattaagggcggtgcaagatgtgctttgttaaacagatgcttgaaggcagcatgctcgttaagagtcatcaccactccctaatctcaagtacccagggacacaaatactgtggaaggcagcagggtcctctgcctaggaaaaccag

SEQ ID NO: 12275 - DNA, 313 bp, Homo sapiens
cccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 12276 - DNA, 297 bp, Homo sapiens
  misc_feature 52, 168, 170, 251: n = A,T,C or G
gcgtgaagcagtgtgggcctgaagtgtgatttggcctgtgaacttggctgtnccagggcttctgacttcagggacaaaactcagtgaagggtgagtagacctccattgctggtaggctgatgccgcgtccactactaggacagccaattggaagatgccagggctttncnagaagtaagtttcttcaaagaagaccatatacaaaacctctccactccactgacctgggggtcttccccaactttcagttntacgaatgccatcagcttgaccagggaagatctgggcttcatgagg

SEQ ID NO: 12277 - DNA, 223 bp, Homo sapiens
  misc_feature 111, 145: n = A,T,C or G
ctcgtgccgattcgggacgagtctcagccattttgggcatatgtatctttataatcagactggaaacgggactttctattaatatcattttcagaataaaaaataggatantttaacctaccagcccttctcccccaataactgnggtctatacagagtcaatatattttttcagagaaagttattcgctcgattttttctgaatcataattaaactttatga

SEQ ID NO: 12278 - DNA, 281 bp, Homo sapiens
  misc_feature 53, 57: n = A,T,C or G
tgctcatgatggctggtatcgatgactgctacacctcagcccggggctgcacntgcnaccctgggcaactttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagc

SEQ ID NO: 12279 - DNA, 164 bp, Homo sapiens
aagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcac

SEQ ID NO: 12280 - DNA, 294 bp, Homo sapiens
  misc_feature 252, 281: n = A,T,C or G
tgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagaaggcgtgtctggaccaggatgctgtgatcgcctccttcgaccagctgtacnacgcctggcggggcggggctggacttggngcaatgccggctg

SEQ ID NO: 12281 - DNA, 351 bp, Homo sapiens
gaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgccgctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatag

SEQ ID NO: 12282 - DNA, 352 bp, Homo sapiens
taacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcaga

SEQ ID NO: 12283 - DNA, 285 bp, Homo sapiens
ggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaactttacggcaagcctgtccatcatggtgttaaccag

SEQ ID NO: 12284 - DNA, 130 bp, Homo sapiens
cgccggctcaacaagcacgaggagaacctgaagaccaagaagcagcagcggaaggagcggctgtacccgctgcggaagtacgcggtcaaggcctgaggggcgcattgtcaataaagcacagctggctgag

SEQ ID NO: 12285 - DNA, 327 bp, Homo sapiens
catgcagttgttaaactatctaacataatggttgtagcttgcgccagggaaaggctgtctcccaatagatagaaaccacctgaagctggtgatcagcagcttcttaataagatctcaggattttgcgagtaggctcaagcatgcccaccaggaggcaaactggtggagtttaacaggtatatgaccctcctctgggaacactagtcaactggtaagggaaaaatacctcaaatgaacatgcacacaacttcagtaaacacactgtacatgtggccccaccccagggctggcaggccactgtgcatgtggacagcccaccccaaggga

SEQ ID NO: 12286 - DNA, 326 bp, Homo sapiens
ggaactcagaggctcagcagtggtgcctgtggaatgggcctctgttttcaccgagtagttgaccccatctggcacgacagggagactcttttttatccagaagccaaatcaagagaggcttttctgagtgacttggctgtgcttttttccagctttggaaagtatgttgagaatgcgtgctggccctggtggtcttacgttgttggtgtcagatgtaaacttgcgacgtgaaggcagaatttaagtctagctttatttagtccaacacgtgttctgcagcagccgctggctgcagagccaaggggataaccatcccctcccagtac

SEQ ID NO: 12287 - DNA, 325 bp, Homo sapiens
  misc_feature 37: n = A,T,C or G
cttccaaagtgctcgattacaggcgtgagccactgcncccggccagaacttctttcaaaattagagtcagtcttctcaaaccctgctgctgctttatcaactaagtttatgtaacatttaaatcctttgccgtgatttcagcagtatttacagcatcttcaccagcagtggattctatctcaagaaaccacttttttgctcatccataagaagcaactcttcatttgttcacatttgatcatgaaattgaatccattcagtcacatcttcaggctccacttctaattctgttttttgttttgttttgttttgttattgccaccac

SEQ ID NO: 12288 - DNA, 201 bp, Homo sapiens
ctccagtcaattttggtcatcacttgtgattgggttgccaagtcaaaggattttcaacctgagcacaaaagagttgttagagagtttttctaatagttgttaagcaggtttatttatttatttatttatttatttatttatttatttagagactgagtcttgctttgtcactccagcctgggcgacagagcgaggttccat

SEQ ID NO: 12289 - DNA, 324 bp, Homo sapiens
  misc_feature 158, 303: n = A,T,C or G
cgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggngggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgnaaaatactttggtttaatttg

SEQ ID NO: 12290 - DNA, 176 bp, Homo sapiens
gaaacctcgtctctactaaaaatataaaaattaactgggtgaggcagcaggcacctgtaatcccagctacttgggagactaaggtacaagaattgcttgaacccaggaggaggaggttacagtgaactgagatcatgccactgcactccagcctgggtgacagagcgagactccaa

SEQ ID NO: 12291 - DNA, 339 bp, Homo sapiens
aaagaaaggcaaaaaggggcctaaaggggagaaaggagaacagggtgctcctggattagatgcaccctgcccgttggggccagatggcttacccatgcctggctgttggcaaaagggggttacaccatggcttattgccaaaaagagataaggtggcggagagcacacacacaatttgtcttgtattttgagggagttgcagtcctgactgcagatctacagcttccagtattgtgggctcatgtggccacttttggttgaaatacgaaggggttgagcctgttgctgccgccagttttccttgggctgcccttggcagtgaagacatgggaagaggac

SEQ ID NO: 12292 - DNA, 326 bp, Homo sapiens
  misc_feature 280: n = A,T,C or G
ctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgccttggaggtggaggggaagatggtcagtaggacagaaggtaacattgatgactcgctcattggtggaaatgcctccgctgaaggccccgagggcgaaggtnccgaaagcacagtaatcactggtgtcgatattgtcatgaaccatca

SEQ ID NO: 12293 - DNA, 325 bp, Homo sapiens
attagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcag

SEQ ID NO: 12294 - DNA, 324 bp, Homo sapiens
cttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactgcaacacagtcactcctggcggcaaaccaaacaaaaccagagtcatctggggaaaagtaactcgggcccatggaaacagtggcatggttcgtgcca

SEQ ID NO: 12295 - DNA, 325 bp, Homo sapiens
gacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacag

SEQ ID NO: 12296 - DNA, 253 bp, Homo sapiens
gagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaat

SEQ ID NO: 12297 - DNA, 325 bp, Homo sapiens
tgccaccagagtgaccctcaaaccccaaagtcgtgtcaaataaaacctctaaatcaattccccaccaatctacttatagaatcctgactccccagggtatgaattcactctctagacagtaatggttacttccagaatcccttccatctctgacccatgacctgtgctttgggccatctctcccagtggtttatatcatctgcctgctttaggaatacacaaactatgaggaaaacaagtgcaaaacaaaggagtaatggcacctgaaattttggtgtcttccgagtgctctcttgacatacactgagatcagcgaattttccta

SEQ ID NO: 12298 - DNA, 325 bp, Homo sapiens
gcatttacaatcctttagctagacacagagcgctgattggtgcatttttacagagtgctggttggtgcatttacaatcctctagctagacagaaaagttctccaagtccccactcgacccacaagtccagctggctccacctctcaacatgatgttgcccaggctggtcctgaactcctgtacttaagtgatccactggcctcaggctcccaaagtgctgggattacaggtgtgagccaccaaacacagctggtactattattagccccatttgatgagtgaaaaaaatagagacaacagagagggctgacaactttcccaacat

SEQ ID NO: 12299 - DNA, 271 bp, Homo sapiens
  misc_feature 118, 166, 167, 181, 214, 238, 261, 268: n = A,T,C or G
aaggcctcgaggccacacaggggctgctggccggcgagtgggccccacccctctgggagctgggcagcctcttccaggccttcgtgaagagggagagccaggcttatgcgtaagcttnatagcttctgctggcctggggtggacccaggacccctggggcctgggnnccctgagtggtggnaaagtggagcaatcccttcacgctccttggccntgttctgagcggccagcttggccntttgccttaataaatgtgctttnttttctnttc

SEQ ID NO: 12300 - DNA, 312 bp, Homo sapiens
  misc_feature 228, 239: n = A,T,C or G
ttcggcacgaggtctatggcacctccctccctctcaaccacttgagcaaactccaagacaccttctaccccgacaccagcaattatgccaagggccatttaggctctcaacatgactatagagaccccgtatcatcatggagacctttgttcctgtgggaaaataaccctcccacctgcaacagctgcccctgctgactgcgcctgtcttctccctctgaccccaganaaaggggccgnggtcagctgggatcttctgccaccatcagggacaaaccgggggcaggaggaaagtcacttgatgcccagcttg

SEQ ID NO: 12301 - DNA, 349 bp, Homo sapiens
gtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagc

SEQ ID NO: 12302 - DNA, 102 bp, Homo sapiens
  misc_feature 99, 102: n = A,T,C or G
aggaactgtgtgtgtcctacacaatggtgctattctgtgtcaaacacctctgtattttttaaaacatcaattgatattaaaaatgaaaagattattggnaan

SEQ ID NO: 12303 - DNA, 322 bp, Homo sapiens
  misc_feature 107: n = A,T,C or G
ggccttcaggatgcatttgtttgaaatcaagggccaaattgcctggaagagcgaaaactgctagatgccagctgaggcggaatgccagccttggaactgacacatcntttctggagagatccatatgcacgaccctagtttgtcttcaaagtggttcccttgaattgattttgtaaattaacaatattaggccttctgtaggatagaaagtgcattagtcacactgctcttactttacccagcaaggaaatctattgttcttttgtaataaaatggttctggaaggggtgagggtgattttgccacatcaggtaaaaggaat

SEQ ID NO: 12304 - DNA, 192 bp, Homo sapiens
ttgagatgagcctgggcaacatggcgaaacctcatctgtactaaagaaacaaaaattagccaggtgtggtggtggacgcctgtggtcccatctactgggaggctgaggtgagagtcacttgggcccaggaggtcgaggttgcaagtgagccatgaacatgtcactgtactccagcctgggtgacaaagtggg

SEQ ID NO: 12305 - DNA, 322 bp, Homo sapiens; identical to SEQ ID NO: 7471

SEQ ID NO: 12306 - DNA, 327 bp, Homo sapiens
tggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggt

SEQ ID NO: 12307 - DNA, 329 bp, Homo sapiens
cggtaccggaccctgcagccgcagaagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagac

SEQ ID NO: 12308 - DNA, 317 bp, Homo sapiens
tggacttccaggacgccagtgacgacggtagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatat

SEQ ID NO: 12309 - DNA, 103 bp, Homo sapiens
  misc_feature 20: n = A,T,C or G
agtacttctagagcggccgngggcccatcgattttccacccgggtggggtaccagggtaagtgtacccaattcgccctatagtgagtcgtattacaatttcac

SEQ ID NO: 12310 - DNA, 326 bp, Homo sapiens
  misc_feature 186: n = A,T,C or G
cagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggnggtgctgctgtttgaaaccgccctgctatcttctggcttttcccttgaggatccccagacccactccaaccgcatctatcgcatgatcaagctaggtctaggttttgatgaagatgaagtggcagcagaggaacccaatg

SEQ ID NO: 12311 - DNA, 327 bp, Homo sapiens
  misc_feature 52: n = A,T,C or G
tgttcttggtgagaagggccggcggattcgggaactgactgctgtagttcanaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaacta

SEQ ID NO: 12312 - DNA, 332 bp, Homo sapiens
tcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggctggtggacctgctccagcagctggtgctgcaccagcaggaggtcctgccccctccactgctgctgctccagctgagga

SEQ ID NO: 12313 - DNA, 325 bp, Homo sapiens
  misc_feature 182: n = A,T,C or G
ctcgtgccgctcatgcctgtaatcctagcactttgggaggctgaggtgggcagattgcttgagctcaggagttcgagaccatcctggacaacatggcaaaaccccatctctactaaaaatacaaaaactagctgggcgtggtggtgggtgcctgtagtcccagctactcgggaggctgaggnggaagtatcacctgagcccgggaggttgaggctgcagtgagccgtgttcaggccactgcactccagcctgggtgacagagggaggccctgtttcaaaaaaaacagaaaaaccaagtacttaacagtttgttttgaactccagt

SEQ ID NO: 12314 - DNA, 320 bp, Homo sapiens
  misc_feature 167: n = A,T,C or G
taaaagtcagactggctgtctctctttctctcttcctctttctttctttctttctttccttttgctcacaacaggattacttagtgtttcaaaagtgggagagagcctccttaaatggtttacagccctttgaatgtatttggtgcagtgacatcccctgaaacttnagtctgcaaagtctcaacatggtaactttgttcttttcttttttaaaggcagatgctgcttttagtgtccctttatttattccaggaaaaatgtggacatcagctaggcacgcctagcaaagaaagtggaggctgctggtttctgtgctttaa

SEQ ID NO: 12315 - DNA, 331 bp, Homo sapiens
gatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggag

SEQ ID NO: 12316 - DNA, 200 bp, Homo sapiens
  misc_feature 108: n = A,T,C or G
tactaacctagccaccctgggagagaacagaaagctgtccctggctgcgctttctcagccctgggaggggcgcctgaacccagaacatttccctaaccccaacctggnaggactcagccacttcttcaggaatttcacttatttggacgggattttaggtttccctcccttccccaaaccatacagttgagaagtaattc

SEQ ID NO: 12317 - DNA, 331 bp, Homo sapiens
cgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtga

SEQ ID NO: 12318 - DNA, 331 bp, Homo sapiens
cgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaagccctggctctcctgctgtccgtgggtgggtgtgggtgtgtcgggggcccgcagtcccctgtctggtgcccgctctgagccacaccctctccgggtgctgcctggtcgtgaatcaaaagccgtggcccgcccacccttcccggggcagcaggtgaggaagccgccgta

SEQ ID NO: 12319 - DNA, 312 bp, Homo sapiens
aagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaaga

SEQ ID NO: 12320 - DNA, 323 bp, Homo sapiens
  misc_feature 174, 245, 310: n = A,T,C or G
aagacacccacaccccaccacctcaccagcagcacaccagcggcagcagcagtataaccacagacattcgtcactgtgccagatcagggcataattctcttaaggcagctgaggccttcacattagttcttgcctcattcaggcatccagaggtcctctctctttgatactggngacataaaccagaggggcaagactaggcatagttccttgatgagttcagtggtgcctcaccgtacccttanaaagccagccctgctgtgctaggtcttgtctcacacaaagacatgctcccaggggtgggcaccgnggatcatggtatt

SEQ ID NO: 12321 - DNA, 297 bp, Homo sapiens
aaaaggttaatctcccagggccaggcacggtggctcacacctgtaatcccagcactttgggaggccgaggcgggtggatcacaaggtaaggagatcgagaccatcctggctaacatggtgaaaccctgtctctactaaaaatacaaaaaaattagccgggcatggtggcagacacctatagtcccagctactcggcaggctgagccaggagaatggcatgaacctgggaggcggagcttgcagtgagccaagattgggccactgcactccagcctgggcaacagagcgagactccat

SEQ ID NO: 12322 - DNA, 313 bp, Homo sapiens
  misc_feature 307: n = A,T,C or G
ccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcctttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaanttaaca

SEQ ID NO: 12323 - DNA, 217 bp, Homo sapiens
aaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 12324 - DNA, 322 bp, Homo sapiens
  misc_feature 297, 299: n = A,T,C or G
cctccccccggcgcgcggccccgcccaggacgaggggcggtgggcaggcagcgctgggtccagtggtcgggggaaggcgaggattaccctcccggaggcgttgtctgcgactcggcggaggctccaacttccagtggcccggtcggggaaagatcagagcctcctaagaaatatccagaagtcaagccatggatcccacctgcccgttaaagaaaaaaaccaaagttaaagaatctgtcagcagagttgagaaaggccaaacagaaaatcagccccagcagggagcctgaagcaganancaaagagccagagatctatgccc

SEQ ID NO: 12325 - DNA, 279 bp, Homo sapiens
  misc_feature 2: n = A,T,C or G
gngaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagag

SEQ ID NO: 12326 - DNA, 322 bp, Homo sapiens
ggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtg

SEQ ID NO: 12327 - DNA, 316 bp, Homo sapiens
atttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgt

SEQ ID NO: 12328 - DNA, 300 bp, Homo sapiens
ccttaatccttggtttattcacacttggattcaaattcaggttccttttttgataaagaggaaatttgttttccatgcttgtgattttgtgtttgtaaacatttcaggaggaatttaggagtgtaactatagtttatacttctataatgttgtcttacatttacatttttaagtgcctaattgttaaaactgatttatgtttctcttctaaagaggatatgtgtacttggtttctaatctctttggttttgctttttaaaaaatgcaagagcctatactttgtatttacctaataaacca

SEQ ID NO: 12329 - DNA, 211 bp, Homo sapiens
  misc_feature 3, 59, 70, 159, 163, 164, 193: n = A,T,C or G
ccnctgcccactggatgctggccagcctctgccattaacacgcctacctcctcactggngtgatcaaatnggtactgctcttatgaaattatgtgtgttagctggctcttcagaaataaaatatcttttcttaaagaaattaaggtttcattttaaatngacnntatggcctttgaaaaactttagtttttgngtggtccaaagctatagg

SEQ ID NO: 12330 - DNA, 102 bp, Homo sapiens
  misc_feature 49, 62: n = A,T,C or G
gcagaactttgttctgtttcctgccacaaaaatgtgaatagttcagagngaaaaccttttgngatgggtgatgtctcaggaataagctggatctccaatgtt

SEQ ID NO: 12331 - DNA, 317 bp, Homo sapiens
ggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgccttttgccctggccaaggagaaagcgccctctatcatcttcat

SEQ ID NO: 12332 - DNA, 325 bp, Homo sapiens
ctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgac

SEQ ID NO: 12333 - DNA, 154 bp, Homo sapiens
aaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgaatcccaataaagcatta

SEQ ID NO: 12334 - DNA, 290 bp, Homo sapiens
gactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccat

SEQ ID NO: 12335 - DNA, 328 bp, Homo sapiens
tgggagacattatgtctgggaataagacatctatttccatagcactgtagtcctgcaaaggagttggaagttatgaatttttaaagattttagaacattatatctttagtctctcataagccaattatttatatctccacatagcccattattaccattgaaaaggcatgcaattcttctatttgaagcttgttccctttttacaaaagtactagtaaaaatctgagtcatacaaaagagcaggtcaggtgtcactaataacagtttacctcagcttcatctccatgaaggttttacttctaatcccagagtctcatgtttatgtatt

SEQ ID NO: 12336 - DNA, 288 bp, Homo sapiens
gaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtacttggattgaccccaaccaaggctgcaacctggatgccatcaaagtcttctgcaacatggagactggtgagacctgcgtgtacccca

SEQ ID NO: 12337 - DNA, 198 bp, Homo sapiens
  misc_feature 7, 40, 50, 57, 78, 81, 116, 151, 185: n = A,T,C or G
ccgcagngggcagagctagtccctgcccgccagggttagncacgattgcnagcatancatcgcacagtggtgatcctnggngaaacagatgtgggggagggggtgcccagcctgtngggggagtctgggaaagcttctgaaacgtgacatntaagctgagccaggaaagatgagtaggaactggncggggaaggagtg

SEQ ID NO: 12338 - DNA, 220 bp, Homo sapiens
cacaatctttcagctaacttattctactccgatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgccccgaggggagcaaggacagctttgcagttctcctg

SEQ ID NO: 12339 - DNA, 183 bp, Homo sapiens
  misc_feature 6, 18, 29, 58, 172, 173, 174: n = A,T,C or G
cctggntgaccaggctgnggcccgcaggnctaagaccaaggaagcacgcaagcgccgngaagagcgcctccaggccaagaaggaggagatcatcaagactttatccaaggaggaagagaccaagaaataaaacctcccactttgtctgtacatactggcctctgtgattacnnngatcagcca

SEQ ID NO: 12340 - DNA, 123 bp, Homo sapiens
  misc_feature 15, 16, 45, 73, 84, 89, 109: n = A,T,C or G
gaagcagaaatgccnnactatagaacagagcttcttaaagggggnccctggaccagcagcatcaacatcacangggaactggtnagttntttctccagacctaccgagncagaaactccgaag

SEQ ID NO: 12341 - DNA, 400 bp, Homo sapiens
  misc_feature 2, 5: n = A,T,C or G
antgngcgcctgcaggtcgacactagtggatccaaagaattcgttacgaggcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagag

SEQ ID NO: 12342 - DNA, 319 bp, Homo sapiens
gatttgtcagataatcaagccacactaactatggaaaatgagcagcattttaaatgctttctagtgaaaaattataatctacttaaactctaatcagaaaaaaagaatattctcaaaaaaatctattatgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccacta

SEQ ID NO: 12343 - DNA, 350 bp, Homo sapiens
cagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccacaaaagccaaaaaatgggagacaatttcacatggactttggaaaatatttttttcctttgcattcatctctcaaa

SEQ ID NO: 12344 - DNA, 325 bp, Homo sapiens
  misc_feature 99: n = A,T,C or G
ctttcttcaagtattgagttctgttcaatgcattggacatgtgatttaagggaaaagtgtgaatgcttatagatgatgaaaacctggtgggctgcagancccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcg

SEQ ID NO: 12345 - DNA, 330 bp, Homo sapiens
tcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcaggatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtg

SEQ ID NO: 12346 - DNA, 351 bp, Homo sapiens
  misc_feature 172: n = A,T,C or G
aagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggngaatttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagag

SEQ ID NO: 12347 - DNA, 331 bp, Homo sapiens
  misc_feature 8, 27, 40, 75, 161, 164: n = A,T,C or G
tggccctncatccccctgctttctttntggcctgcctggntccctgaggacaggacagctggccatacacctggnggctggccctccctgcaagggtacggaaccctggctcttctgaaggcaggacaggttaagggccccttcctcccacaaccatggcnaangaaggctcctggggcagccacgctgggccaaaaaaggaaatcaagagaagtggaaacttttcagtccagagctgccgaccaaagcaggggaagtgcagtcagtctcttgtgacagagccgtgtgaagctgggggtggacaggctatcagctagtggcccatctactt

SEQ ID NO: 12348 - DNA, 241 bp, Homo sapiens
  misc_feature 144, 181, 184, 211, 235: n = A,T,C or G
ttcggcacgagcgataggaaacgaggctgcctcgcggtggcaccgccaccccccaaccgggttccgagcaccggagctggctgctgctccctctttggagcaaagttttatgcaaagagggtgttttttgaaactttcggtgcncgaaaaataactaaacatgggcaaaggagatcctaanaanccgagaggcaaaatgtcatcatatgcnttttttgtgcaaacttgtcggggnggagct

SEQ ID NO: 12349 - DNA, 325 bp, Homo sapiens
ctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggg

SEQ ID NO: 12350 - DNA, 331 bp, Homo sapiens
gtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtg

SEQ ID NO: 12351 - DNA, 179 bp, Homo sapiens
aaatttaaaaacggcaacaacaacaaaaaaccctactagctgtgcagcggagtggtgcgcacctgtggtccctaactacaagctactcagaaggcaaggtaggagcatcactggggcccaggaggtcaaggctgcactgttcataccattgcactccagcctgggtgacagagcgagac

SEQ ID NO: 12352 - DNA, 156 bp, Homo sapiens
gctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcg

SEQ ID NO: 12353 - DNA, 100 bp, Homo sapiens
tacaggctcccatctcgctgagggagcccatgtcagccaatgacctttgttacaccccagggccttgaggcatataaataaggagcttttctatccaaac

SEQ ID NO: 12354 - DNA, 329 bp, Homo sapiens
gaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttc

SEQ ID NO: 12355 - DNA, 222 bp, Homo sapiens
  misc_feature 126, 173, 174: n = A,T,C or G
tcgaaacctagtcacattggagagtggggggagtgggggagttgtgtggcggatcagagcctcaaacacaaagctggtgtgtgcagttgggagtcggaatgggactgaagaaaccaagctgctggngctggactttgatgtggacatgaagtgaagagcagaaaagatgaatnngtccaattgtgtagacgatatactccctgcccttccccctgcaaaaag

SEQ ID NO: 12356 - DNA, 351 bp, Homo sapiens
ggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatc

SEQ ID NO: 12357 - DNA, 326 bp, Homo sapiens
aggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaactgtgctctttattttaaaaaacactgataatcacactgcggtagggtcattcttttgccacatccctatagaccactgggtttggcaaaactcaggcagaagtggagacctttctagacatcattgtcagccttgctacttgaaggtacaccccatagggtcg

SEQ ID NO: 12358 - DNA, 361 bp, Homo sapiens
  misc_feature 3: n = A,T,C or G
ctngtgccgcaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctc

SEQ ID NO: 12359 - DNA, 283 bp, Homo sapiens
  misc_feature 16, 48, 73, 84, 217, 231, 277: n = A,T,C or G
cctcagtctcccaagngactgggaccccaggtgcgtgccacaaagccnggctaattttttttagagatggggnctcactatgtngcccaggctggacttgacttctgggctcaagccatccttccaccttggctcccaaagcactgagattgcaggcgggggctactgggccgggccaaaaaaagtctttaaaacaaaataagtagtaaataggttngcatcaatttttgnttttttctttctctttgcaaagaagcaggagggcatcttatctggngatcta

SEQ ID NO: 12360 - DNA, 331 bp, Homo sapiens
gccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagct

SEQ ID NO: 12361 - DNA, 362 bp, Homo sapiens
cataaatcaacctgagtaggggacagttttagtgacacactttggtgcttctgagaacagcacaaaattattctcttgtttataatggatattgcattctgctcagtactggtgagggaaatctgttctcaagtcctacagtgcattcatgtgtcctgaagtccagaattctgtaggatagtgtcctacgttataagcctggagaaagaaatcataattctttaatttttatttttttagggaaatgatgtcactctgaaactcaggctggaatacactggcatggtcatacctcactgcggcctcaaactcctgggctcaagtgatcctcctgcctcagcctcccgagtacctgagattag

SEQ ID NO: 12362 - DNA, 345 bp, Homo sapiens
  misc_feature 7, 169, 174: n = A,T,C or G
gcagctncaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggntcatnaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgaga

SEQ ID NO: 12363 - DNA, 349 bp, Homo sapiens
cccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatggga

SEQ ID NO: 12364 - DNA, 323 bp, Homo sapiens
ccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgta

SEQ ID NO: 12365 - DNA, 323 bp, Homo sapiens
gggagtctaagtctctttgtaggtcactcagaacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttattttccatttgcttggtagatcttcctccatccttttattttgagcctatgtgtgtctctgcccgtgagatgggtttcctgaatacagcacactgatgggtcttgactcttt

SEQ ID NO: 12366 - DNA, 324 bp, Homo sapiens
  misc_feature 198, 280, 298: n = A,T,C or G
caacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctntgctaaagcccgggcacccgcccagccgggctgggccctccctgccacactagcttccaagggctgcccccgacaggctggnttttagtggaggccaaanatctggaatcggggtcaggggggcta

SEQ ID NO: 12367 - DNA, 286 bp, Homo sapiens
ccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 12368 - DNA, 326 bp, Homo sapiens
gcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgtctctgcctttatcctgggagatgggggaaggaagccccatctctgctgttccccgcgtggaggaagcccacccagcaagctctctcctaccccaggtaaaagg

SEQ ID NO: 12369 - DNA, 327 bp, Homo sapiens
cttttgtcctctgtactaaagctccagtgccattcctttgctttgaaaattaagtactgcagtactatctcctggccacttgtgggtccttgttagactaccgactcttctgttcatctaaaacgtgaaagtcacagatatcccaggtagaggaaagttcccaaatctctgttttattcatccccttactgtttctgttttaaaccctggccatctgcctgttgccatgtattccttagtacctagcacagtccctggaatatagtaggtgctcagtaaatccgttgaataatgaaaatgctcccctactcgtcacaagacagaaca

SEQ ID NO: 12370 - DNA, 326 bp, Homo sapiens
  misc_feature 200, 264: n = A,T,C or G
gacgccgccacctccggaacaagccatggtggcggctacggtggcagcggcgtggctgctcctgtgggctgcggcctgcgcgcagcaggagcaggacttctacgacttcaaggcggtcaacatccggggcaaactggtgtcgctggagaagtaccgcggatcggtgtcccttggtggtgaatgtggccagcgagtgcggnttcacagaccagcactaccgagccctgcagcagcttgcagcgagacctgggcccccaccacttnaacgtgctcgccttcccctgcaaccagtttggccaacaggagcctgacagcaacaaggagat

SEQ ID NO: 12371 - DNA, 320 bp, Homo sapiens
gctacctggctaaagacggctcgaaattctactgcagcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaaca

SEQ ID NO: 12372 - DNA, 324 bp, Homo sapiens
ccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagg

SEQ ID NO: 12373 - DNA, 107 bp, Homo sapiens
cgaggccagcacaccaagaccactggccgccgtggccgcaccgtgggtgtgtccaagaagaaataagtctgtaggccttgtctgttaataaatagtttatatcccat

SEQ ID NO: 12374 - DNA, 318 bp, Homo sapiens
ggaagatggcggcagcggcggcggcggctgcagaacagataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgagga

SEQ ID NO: 12375 - DNA, 332 bp, Homo sapiens
ggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatg

SEQ ID NO: 12376 - DNA, 323 bp, Homo sapiens
ctcgtgccgaacacaaattaccaatatcaaaatgagggaacatcactacgaattctgcatgtattaaaaggaaaaataggctgggtgcagtggctcctacctgtaatcccagcactttgtgaggccgaggcgggcggatcactgggatcaggagtttgagaccagcctggctaaagaaaatacaaaatttagtcaagcaaggtggcgagttcctgtaatcccagctgctctcgaagctgaggcacgagaatcacttgaacccaggaggcagaggttgcagtgagctgagatcgcaccactgcactcccgcctgggtgacagag

SEQ ID NO: 12377 - DNA, 284 bp, Homo sapiens
cggccccccaggtcctcaaggtcctccaggctatggcaagatgggtgcaacaggaccaatgggccagcaaggcatccctggcatccctgggcccccgggtcccatgggccagccaggcaaggctggccacttgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtg

SEQ ID NO: 12378 - DNA, 233 bp, Homo sapiens
  misc_feature 13, 28, 34, 39, 66: n = A,T,C or G
taactggttaaanaacccgtttttgggngcctgnggtcnacactagtggatccaaagaaattcgtncgaggctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtg

SEQ ID NO: 12379 - DNA, 398 bp, Homo sapiens
  misc_feature 8, 24, 364: n = A,T,C or G
gattttanggaaaaaacctggatntcgcgcgcctgcaggtcgacactagtggatccaaagaattggcacgagacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcanacctggccgtcttgatcagctcatctacatccca

SEQ ID NO: 12380 - DNA, 317 bp, Homo sapiens
ccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatatttt

SEQ ID NO: 12381 - DNA, 321 bp, Homo sapiens
gtgaaatcaccaggtaaaggataaggacagaatcctaaggagcatcaacactaagggaaggacagaagctagagctgacaggagggagaccaggagagggtggtggcatagaagataagggagactatttcaggaaggacattctagccaaaggggccatgctgcaaagagataacaggtcacatatgaaatgaaagggctccattggattatttgcttattatccacattaaatgttctattttaacctaaaagatataaaatacacatttacttgccaatgttttgatgtaaagttaagacctttccttcgagaatggg

SEQ ID NO: 12382 - DNA, 388 bp, Homo sapiens
  misc_feature 8, 39, 218: n = A,T,C or G
gcgcctgnaggtcgacactagtggatccaaagaattcgncccgagatttagttaaaacatgtgtcttgatttacctttaatctagaaaagttctgggcatttttttctttcatgattgaaaagtgaatgtttggggtaagaataacacgtagtttaatattcaaattgccccagatttggcatgtttatattattttaatatgtcattttctagtttngactgtgtccttgtcttctgacacaagtagatgttacagatcaaatgtaatttccttgccacatgctgaaatccatcagttgccccagaagtgtcatactttttattagaaaatggcatttgaggccgggcacggtggcctcatgcctgtaatcccagcactttgggagg

SEQ ID NO: 12383 - DNA, 143 bp, Homo sapiens
gtataagtaacatgaaaacattctcctccgcataagcctgcgtcagattaaaacactgaactgacaattaacagcccaatatctacaatcaaccaacaagtcattattaccctcactgtcaacccaacacaggcatgctcata

SEQ ID NO: 12384 - DNA, 353 bp, Homo sapiens
cactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgta

SEQ ID NO: 12385 - DNA, 348 bp, Homo sapiens
gccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgt

SEQ ID NO: 12386 - DNA, 323 bp, Homo sapiens
  misc_feature 141, 145, 158: n = A,T,C or G
tggtaaccatgataaagtctgttattaataacaacataattctttttttaaagaaaagcttatttttcattgacagtgtatagatttatctacttagttgtgttttgctattagtgttttaattttttttttaagttgagngttngataaattttaanaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgt

SEQ ID NO: 12387 - DNA, 371 bp, Homo sapiens
gaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataagg

SEQ ID NO: 12388 - DNA, 314 bp, Homo sapiens
  misc_feature 67: n = A,T,C or G
ccgaattcggcacgagctttgacatctgtaacccctcattgtctgcctcatttattttacccttcanaagtagctagtctccttcctgtgatccaggcgggtatctgtgtcctcttgctgcctgtccgtttattccccaatcgtaatataaagaaactgagtagccaattcagagggtcttcatttggtttgagtatgtttcagactgataattgtttaatatttttagctgtcatttaatagcattgttataactaatatatttgtataggtattctgctacacggaatctctgttgtagaatcagggcacct

SEQ ID NO: 12389 - DNA, 127 bp, Homo sapiens
  misc_feature 126, 127: n = A,T,C or G
ttcggcacgagcagagacgcgtcctctttcttggggaagttgaggagtgcccttcagagccagtagcaggcaggggtgggtaggcaccctccttcctgtttttatctaataaaatgctaacctgcnn

SEQ ID NO: 12390 - DNA, 296 bp, Homo sapiens
  misc_feature 2, 7, 194: n = A,T,C or G
gngacgnaaaataacaatacaggactctttcgaggccctgtaattggaatgagtccactttaaatcctttaacgaggatccattggagggcaagtctggtgccagcagccgcggtaattccagctccaatagcgtatattaaagttgctgcagttaaaaagctcgtagttggatcttgggagcgggcgggcggnccgccgcgaggcgagccaccgcccgtccccgccccttgcctctcggcgccccctcgatgctcttagctgagtgtcccgcggggcccgaagcgtttacttttg

SEQ ID NO: 12391 - DNA, 325 bp, Homo sapiens
  misc_feature 244: n = A,T,C or G
ctttccccctcatcccgtcttcccctcctcccgtcctccctcgccccgcatgctcccggcttgccgcctgcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccganatcaagcagaagtgggcatcccggctgctggccaagctgcgcaaggacatccggcccgagttccgcgaggacttcgtgctg

SEQ ID NO: 12392 - DNA, 321 bp, Homo sapiens
gggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagat

SEQ ID NO: 12393 - DNA, 397 bp, Homo sapiens
  misc_feature 2, 18: n = A,T,C or G
anggaaaaaacctggagntcgcgcgcctgcaggtcgacactagtggatccaaagaattcgccacgagagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatgggggagccccattgctggccttgcatctgaataggccta

SEQ ID NO: 12394 - DNA, 164 bp, Homo sapiens
  misc_feature 26, 60: n = A,T,C or G
gccgtctctgctgccccaggctctgnagcccctgctgctggttctgcccctgctgcagcngaggagaagaaagatgagaagaaggaggagtctgaagagtcagatgatgacatgggatttggcctttttgattaaattcctgctcccctgcaaataaagccttt

SEQ ID NO: 12395 - DNA, 262 bp, Homo sapiens
  misc_feature 93, 235: n = A,T,C or G
agtgcagtttcttttcacattaggctgttggttcaaacttttgggagcacggactgtcagttctctgggaagtggtcagcgcatcctgcaggncttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggntgttctttcctcacatttggatgattg

SEQ ID NO: 12396 - DNA, 183 bp, Homo sapiens
  misc_feature 10, 32: n = A,T,C or G
cgcatgaaangccacactagtggatccaaagnaattcgttacgagctcattgacccttgctggggcgaggctctctggactgaacacaggccaggagctccaagcccagcaggaaaggtattgtgaggcccaaggctccccaccaggccttaagtccccagagaggttccagagggttcagcg

SEQ ID NO: 12397 - DNA, 103 bp, Homo sapiens
tttgttttttgtggcagagtctgtgtagcccaggatggagtgcagtgagccgagatcgtgcccctgcactccagcctgggcaacagactgagactctgtctca

SEQ ID NO: 12398 - DNA, 328 bp, Homo sapiens
  misc_feature 1, 38, 40, 58, 214, 220, 224: n = A,T,C or G
ngccttgaggtccgacactagtggatccaaagaaattntncacgagccgctgtggctntaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcntggatnccgngaaggaacaacacctaaacccaagagggcagctgttgcagcatccagttcatcttaagaatgtcaacgattagtcatgcaataaatgttctggttttaaaaaat

SEQ ID NO: 12399 - DNA, 347 bp, Homo sapiens
  misc_feature 114: n = A,T,C or G
gtggatccaaagaaattcggcacgagtgacagccttgattgctagggacacccagccacacgggctaactcatacagggcagagaggactttcaccctctttaattcaccgtgnatgagtggcaatgtttcttcccaaatatatggctggccctaggagacaagtcagggcatgtgagctgtggatgtgaactgagagaacagttggggcttaggtgaaaagtggagattcaggaactcttcagatatagtggccttagggaaagatagatgtattaggccattcttacattgctataaagaaatacctgagactgggtaatttataaagaaaagaggttatattgg

SEQ ID NO: 12400 - DNA, 306 bp, Homo sapiens
  misc_feature 73, 76, 125: n = A,T,C or G
tgctcgaatatttctggcatcttgcacccctttcttttgattcttcccttagggtgagacaactgcatgtgcnggngccctccttgtgcttgggaggtgagcatgcacagtgtgtttaagaagtngtacacattgctcacctgaggctttcttcccatttccagtggaatgcccctggaaggtcatactctgccattttgtctctcaatgtgcatgcgttgggttcacttgcccaactccccgaaagctgcggggttaccagttacaggtgtttcctctctatataggaagactgccctttccctg

SEQ ID NO: 12401 - DNA, 349 bp, Homo sapiens
  misc_feature 282, 343, 344: n = A,T,C or G
ctccccagctctcggatacagccgacaccatgggtttcggagacctgaaaagccctgcgggcctccaggtgctcaacgattacctggcggacaagagctacatcgaggggtatgtgccatcacaagcagatgtggcagtatttgaagccgtgtccagcccaccgcctgccgacttgtgtcattgccctacgttggtataatcacatcaagtcttacgaaaaggaaaaggccagcctgccaggagtgaagaaagctttgggcaaatatggtcctgccgatgtnggaagacactacaggaagtggagctacagatagtaaaagatgatgatgacattgacccctnntttgg

SEQ ID NO: 12402 - DNA, 320 bp, Homo sapiens
tgcagccgcgagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgaagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcag

SEQ ID NO: 12403 - DNA, 328 bp, Homo sapiens
cattgaaaacatagacttactggctgtagcaatgctggcctgttaactgataactagaacttaggttcacgtttatgtaaagtgtgtaaaacctagtagagcttgatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaac

SEQ ID NO: 12404 - DNA, 345 bp, Homo sapiens
ggaagaaaaaccttttcacgaactacctttttaccaaaaagtgtggctacttaagggtctttgtgactttgtgtatgaaacacaaaaggaagttcaagatgctgtacttggacagcctatccatgaatgcagggaagttattcttggttatgattatttggagaatgcttatgtacattttccacagttctgtggtgcagatgtacggatttataaacagagaccctttcaggccccagaatttccaattccacccattaaaatacaaagagtacctcggattaaattggagaaattgaagtgtgactatgttagtacaagtaatggagaacatagatgtagcag

SEQ ID NO: 12405 - DNA, 241 bp, Homo sapiens
gccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgat

SEQ ID NO: 12406 - DNA, 346 bp, Homo sapiens
  misc_feature 11, 47: n = A,T,C or G
tgtgccccttnaagtgcgacactagtggatccaaagaaattgctcantatgacgcttctgagctaaaagcttccatgaaggggctgggaaccgacgaggactctctcattgagatcatctgctccagaaccaaccaggagctgcacggaaattaacagagtctacaaggaaatgtacaagactgatctggagaaggacattatttcggacacatctggtgacttccgcaagctgatggctgccctggcaaagggtagaagagcagaggatggctctgtcattgattatgaactgattgaccaagatgctcgggatctctatgacgctggagtgaagaggaaaggaa

SEQ ID NO: 12407 - DNA, 337 bp, Homo sapiens
gaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagg

SEQ ID NO: 12408 - DNA, 346 bp, Homo sapiens
cataacttaccaagtaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaac

SEQ ID NO: 12409 - DNA, 324 bp, Homo sapiens
gtaaattggaaagtatttgagagttgcataggattcaggaataaaggttttggatatttattaatggattttaaaatgatgattaagctttgaactaattttaaatttccgtttccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtggtaccgtagggggtgcaaatcaatttctgagtgacacttaacacagtttaagaatggctcatgta

SEQ ID NO: 12410 - DNA, 395 bp, Homo sapiens
  misc_feature 2, 6, 34, 36, 192, 244: n = A,T,C or G
tnaagnagccacactagtggatccaaagaattcntncgagtaaactagtacaaccagtatggagattctttaaagaactaaaagtaggactaccatttgacccagcaatcccactactgggcatctacccagaggaaaagaagtcattacatgaaaaaagacacttgcacatgcttgtttatagcagcacanttcacaattgtaaaaatatggaaccaacccaaatgcccaacaaccaatgagnggataaagaaaatgtggcatatatacatcatagaatactactcagccataaaaaggaacaaaataatggcattcacagcaacctgggtggaattggagaccattattctaagtgcagcaactcaaaaatggaaaaccaaatcttatatgtt

SEQ ID NO: 12411 - DNA, 258 bp, Homo sapiens
  misc_feature 175: n = A,T,C or G
caagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttnggcatacgggcaaaaagagccaaggaagccgcagaacaggatgttgaaaagaaaaaataaagccctcctggggacttggaatc

SEQ ID NO: 12412 - DNA, 144 bp, Homo sapiens
tgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagat

SEQ ID NO: 12413 - DNA, 113 bp, Homo sapiens
aagtacttctagagcggccgggggcccatcgattttccacccgggtggggtaccagggtaagtgtacccaattcgccctatagtgagtcgtattacaattcactgggccgcca

SEQ ID NO: 12414 - DNA, 118 bp, Homo sapiens
  misc_feature 32, 39, 53, 69, 75, 89, 98, 117: n = A,T,C or G
caaagcatggaggtgagctgccacccatcctnacacgantgaagaacttcttngtattctctcgagggnaagggncactgtcaaagatngcggcctanagcaatgtcgcgaaaaggng

SEQ ID NO: 12415 - DNA, 383 bp, Homo sapiens
  misc_feature 380: n = A,T,C or G
tcgagggaaaaacacccgtggagccggaggtggcaattcaccgaattcgaatcaccctaacaagccgcaacgtaaaatccttggaaaaggtgtgtgcttgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttngtt

SEQ ID NO: 12416 - DNA, 386 bp, Homo sapiens
  misc_feature 147, 148, 342, 361: n = A,T,C or G
ggagaggagcacagggtggctctgtggagggaagaggttacagggggaggagctgatgatagatcccacccagacttaagctgctggtgggtgggtgagctgggaagtaggactgtccagggaagggtggagagatgtagctagggnntggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggcctgctgaatttcctggaaggggngattggatggaaaagaggnccagaaaccccagcctgagagactg

SEQ ID NO: 12417 - DNA, 115 bp, Homo sapiens
  misc_feature 11, 19: n = A,T,C or G
tgaaactgtanaatatccntgtgtcaggcttggagttcattgtgacctccaaattttgcctgaaggaccagctgggcaaagcatcttttaaatgttcagaggccaaaagataaac

SEQ ID NO: 12418 - DNA, 245 bp, Homo sapiens
  misc_feature 13, 59: n = A,T,C or G
tcgacgtgcagcngagctccggagctgacagactcgctcaggaccctgaagcccgaggncaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaaatctcttctagctg

SEQ ID NO: 12419 - DNA, 396 bp, Homo sapiens
  misc_feature 5, 14, 148: n = A,T,C or G
tgatnacgttcctnaagtctgccacctgctcaccaacaaggtgcagtacgtgattcaagggtatcacaaaagaagagagtatattgctgcttttctcagtcactttggcacaggtgtcgtggaatatgatgcagaaggctttacaaanctcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaagcctttgtccctcagttccaggaggcagcatttgc

SEQ ID NO: 12420 - DNA, 317 bp, Homo sapiens
  misc_feature 251, 314: n = A,T,C or G
ggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagntttcaaggataggctttattctgcaagcaatcaaaataattaaaatctatttcttgcttaggngat

SEQ ID NO: 12421 - DNA, 323 bp, Homo sapiens
agcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaacttcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaat

SEQ ID NO: 12422 - DNA, 261 bp, Homo sapiens
  misc_feature 13, 22, 107, 119, 127, 145, 221, 238: n = A,T,C or G
ctcgtgccgattnggcccgggnaaaaaagctggaagatggccctaaattcttgaagtctggagatgctgccatttggtgatatggctcctggcacgcccatgtgtgntgagagcttctnagactatncacctttggggcgctttntggtcgagatatgagacagacagttgcggggggtgcatcaaagcagtgacaagaaggctgctggagctgcaggacnccaagtctgcccagaangctcagagggctaaatgaatatt

SEQ ID NO: 12423 - DNA, 127 bp, Homo sapiens
ggcgcctgtagtcccagcaactcgggaggctgaggcaggagaagggcgtgaacccgggaggcggagcttgcagtgagatgagatggcgccactgcactccggcctgggggacagagcaagactccgt

SEQ ID NO: 12424 - DNA, 335 bp, Homo sapiens
ggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataata

SEQ ID NO: 12425 - DNA, 311 bp, Homo sapiens
  misc_feature 52, 68, 203, 287: n = A,T,C or G
ttcggcacgagtttgctaatagtttcctgttccttgttttagctattttggnaaaagtgactaatggngcagcaaccatttcttcaccagcccttcctcagctctcctctccactccctcctcctcaggattatagggtccttcttgctgctgtatcaggtctcagctcattagttgtttgaggaaagggcctgccatgccantgttcatcacttcagccacaaaggatggcttttactcagcaatcatgtgctgaacatctgctacattccactcttagcactagngaaacaaacgcgtagcaacagagc

SEQ ID NO: 12426 - DNA, 322 bp, Homo sapiens
aggaaatgcactgactgcatgttattgtggcaagaatatcctaaatgtcattaaaatcctccaacatgatggatctccttatggtcttgtttgttgacatgccaaattaacatagttccatctggaaatgagcatttgaaatgataatccggctgggcacagtggctcacccctgtaattttagcactttgggaggccgaaggggggcagatcacctgaggtaaggagttccagaccagcctggctaacatggcgaaaccttgtctctactaaaacacaaacgcacacacacacaaaattagccaggcatggtggtgcattg

SEQ ID NO: 12427 - DNA, 330 bp, Homo sapiens
  misc_feature 2, 10, 41, 44, 68, 196, 315: n = A,T,C or G
gngcgcctgnaggtccgacactagtggatccaaagaattcnttncgagggtttgcttaggcgcagacngggaagcggagccaacatgccagtggcccggagctgggtttgtcgcaaaacttatgtgaccccgcggagacccttcgagaaatctcgtctcgaccaagagctgaagctgatcggcgagtatgggctcnggaacaaacgtgaggtctggagggtcaaatttaccctggccaagatccgcaaggccgcccgggaactgctgacgcttgatgagaaggacccacggcgtcttgttcgaaggcaacccccntgttgcggggggttg

SEQ ID NO: 12428 - DNA, 400 bp, Homo sapiens
  misc_feature 5, 8, 37, 157: n = A,T,C or G
cctgnagngcgacactagtggatccaaagaattcgtnacgaggtttaatttcggatttgccttgaaaaatatagtcttactgtacaatatgtcaaacatgtgaattatgtgtaaaaagcaaggaatatatcatgtgaaaatgagattgtgaatatgntattaatagtaaaatgtcaggtggaaaaataggcagagtccaacttggacatatatctgtagctttcatttttccatctatttctctctctcgacacacacatggatatgtttaagttaagacatacatgaatttatttacagataagacacacatgaatttatttatagataagagtaatgaatgtatgtcagacatcatgcggatttatgaatttgatgttttggcttcagatggattatc

SEQ ID NO: 12429 - DNA, 321 bp, Homo sapiens
ctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatga

SEQ ID NO: 12430 - DNA, 200 bp, Homo sapiens
  misc_feature 11, 20, 161, 162, 163, 195: n = A,T,C or G
tactaacctcnccaccctgngagagaacagaaagctgaccctggctgcgctttctcagccctgggaggggcgcctgaacccagaacatttccctaaccccaacctggtaggactcagccacttcttcaggaatttcacttatttggacgggattttaggtnnncctcccttccccaaaccatacagttgagaagnaattc

SEQ ID NO: 12431 - DNA, 202 bp, Homo sapiens
  misc_feature 8, 12: n = A,T,C or G
gcgcctgnaggncgacactagtggatccaaagaattcttacgagtgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtgg

SEQ ID NO: 12432 - DNA, 335 bp, Homo sapiens
aacaaatcatcctgtcaagctgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctgtgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaag

SEQ ID NO: 12433 - DNA, 105 bp, Homo sapiens
  misc_feature 2, 27, 36, 42, 65, 66, 87, 103: n = A,T,C or G
gngacacagcccttatcaacctgctcncaatgctgnatgccntcaggttcaccgttgatgttcgnnccgcgctgagccgaaaccttnaccaacatcggctctnac

SEQ ID NO: 12434 - DNA, 148 bp, Homo sapiens
  misc_feature 14, 40, 64: n = A,T,C or G
gcgcctgaaggtcnacactagtggatccaaagaattcgtncgagccagaagataggaggatggnacctgtgatactgtgctgctggtgggaggacccttccacatcaacatttgtgtgtatccttgcaataaacttccattgtgaatt

SEQ ID NO: 12435 - DNA, 400 bp, Homo sapiens
  misc_feature 28, 36, 66, 68: n = A,T,C or G
ctcttagggaaaaaccctggtttttggngcgcctgnaggtcgacactagtggatccaaagaattcntnacgagtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttccca

SEQ ID NO: 12436 - DNA, 378 bp, Homo sapiens
  misc_feature 31, 74: n = A,T,C or G
cttctatggggaacaaaacccctggtttttngggcgcctgcaggtccgacactagtggatccaaagaattcgtnacgaggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaacctccacgaggtgaaaaatattcagtaactttgtttgcatagcatttgtgtaaagactatgatctcatcccaataaaatgatatattaaatcttcagattaatgactggctacagagtaacaaaaaataaagaatttaatgtacagtaaattctctcccata

SEQ ID NO: 12437 - DNA, 248 bp, Homo sapiens
  misc_feature 8, 12, 88, 189, 195: n = A,T,C or G
gcgcctgnaggnccgacactagtggatccaaagaattctttacgagagaaggcagggacgcctgggtgagaggcaaagggcacagccntgcaaaggccctggggcaggacggcacctggtatgcgggaggaacagagtgaggagaggagggcaggggcgtgcagggccttgtgggcctcagggaggacnttggcnccctaccccgaggaagtggagcttctgggtgcctgtccagatggaaaagcagg

SEQ ID NO: 12438 - DNA, 221 bp, Homo sapiens
tgaagaggggcccccagctcgggacctggtgctgatcagagtggctgctgccccagcctgacatgtgtccaggcccctccccgggaggtacagctggcagagggaaaggcactgggtacctcagggtgagcagagggcacttgggctggggcacagcccctgcttccctgcaccccattcccaccctgaagttctgcacctgcaccctttgttgaattggg

SEQ ID NO: 12439 - DNA, 147 bp, Homo sapiens
cttaagccagccccactacttccttccctgcctcccagctcactatttaaacatcatctcccttctctttctcgcataactccccacccctttctccccgatccacccaggcctttctgtaaataaaagctcccaagttgggtacag

SEQ ID NO: 12440 - DNA, 325 bp, Homo sapiens
  misc_feature 316: n = A,T,C or G
ggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgntcatgttgt

SEQ ID NO: 12441 - DNA, 119 bp, Homo sapiens
  misc_feature 2, 104: n = A,T,C or G
gntaagtccattttccccatggaagaagcccgtagttccatgaagtatggattaccatttgtatttttcactaacagtaaatgtatttttcttattaattgttngccttaggaatgatg

SEQ ID NO: 12442 - DNA, 321 bp, Homo sapiens
gacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcaca

SEQ ID NO: 12443 - DNA, 216 bp, Homo sapiens
  misc_feature 27, 51, 160: n = A,T,C or G
acactagtggatccaaagaattcgttncgagctcgtgccgaattcggacgngcgcaagatagatttggaataggaataagctctagttcttaacaaccgacactcctacaagatttagaaaaaagtttacaacataatctagtttacagaaaaatcttgngctaggaatactttttaaaaggtattttgaataccattaaaactgctttttttttt

SEQ ID NO: 12444 - DNA, 370 bp, Homo sapiens
  misc_feature 16, 19, 173: n = A,T,C or G
cagctttgaaggctgnatnctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatnacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatgg

SEQ ID NO: 12445 - DNA, 345 bp, Homo sapiens
gtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattga

SEQ ID NO: 12446 - DNA, 346 bp, Homo sapiens
  misc_feature 340: n = A,T,C or G
tcgagcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggggttctaaatgtctnaagaac

SEQ ID NO: 12447 - DNA, 400 bp, Homo sapiens
  misc_feature 66: n = A,T,C or G
cttctttgggaaaaaaccctgtccttggggcgcctgaaggcccacactagtggatccaaagaattnttacgaggtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttg

SEQ ID NO: 12448 - DNA, 366 bp, Homo sapiens
  misc_feature 18, 54, 230, 311: n = A,T,C or G
gatttttagaaatgcagncgaaacttgaacaacacaagtttgaactgaactggngacttatatgtgaattttcttcagtttctgccatctctgagacagcaagaccaacctcctcttcctcctcctcctcagcctactccaggttaagatgacaaggatgaagacctttacgatgatccatttccacttaatgaagagtacatatagttcctcttccttacgattttctnaataacattttcttttctccagcttattgtcattgtaagaatacagtgtataatacatataacatacaaaatatgcgttantcaactgtgtatattatcagtaaggccagcagtaggctattagtagttatttttg

SEQ ID NO: 12449 - DNA, 309 bp, Homo sapiens
gataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtcccttgctagttagcgccccaccgccgtggagt

SEQ ID NO: 12450 - DNA, 269 bp, Homo sapiens
  misc_feature 8, 15, 40, 41: n = A,T,C or G
gcgcctgnaggaccnacactagtggatccaaagaaattcnntacgaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgcc

SEQ ID NO: 12451 - DNA, 361 bp, Homo sapiens
aaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccct

SEQ ID NO: 12452 - DNA, 393 bp, Homo sapiens
  misc_feature 28, 30, 38, 68, 70: n = A,T,C or G
cttctttgggaaaaaacccctgtacttngngcgcctgnaggtccacactagtggatccaaagaattcntnacgaggtcttatttgcctgtccaggcatccattaaaaggttggagagtccaggcgcggttgctcacccctgtaatcccaggactttgggaagccaaggcaggcagaccacctgaggtcaggagtttgagaccagcttggcaaacatggtgaaaccctgtctctactaaaaatacaaaaaattagctgggtatggtggtgcatgcctgtaattccagctacttggaggctgaggcatgataattgcttgaacctgggaggcagaggctgcagtgagccaagatcacactactgcactccagactgggcgacagagcaagactgt

SEQ ID NO: 12453 - DNA, 336 bp, Homo sapiens
tgtttgtctatttacattttcaaagcctcttccttttatgtactctttgaatgacaaagctcactttttactgccttagcacctttttttcaccagtggttaataatttatacacaacagtgaatttgatgttaaatatcttatatactaaatgggaattaaaaacatatttaacaagttttttaaaaatttaaaatagcatattctctgctaaaaatattatacttctacttaatcaagagatgctgctctttaaatagaattgagtatcatgtatacgataccgtattcgaaaaattttggagaaaccttctatatccatgctgatgaagttca

SEQ ID NO: 12454 - DNA, 398 bp, Homo sapiens
  misc_feature 13, 18, 33: n = A,T,C or G
gtgggaaaaaacncctgnacttggggcgcctgnaggcccgacactagtggatccaaagaatttggtacgagagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagc

SEQ ID NO: 12455 - DNA, 145 bp, Homo sapiens
ggagggccagagactagtcctgagatggaaacagcaacttgtacagtggctgagaaaataggatatagttttgatttttttaattgtaaaatattttggagggagaacaaaatcttttaacattttgaataaatttagagtttta

SEQ ID NO: 12456 - DNA, 195 bp, Homo sapiens
  misc_feature 10, 52, 55, 110, 115, 135, 154, 188: n = A,T,C or G
tactaacctncccaccctgggagagaacagaaagctgtccctggctgcgctntcncagccctgggaggggcgcctgaacccagaacatttccctaaccccaacctggaangactnagccacttcttcaggaattncacttatttggacgggatnttaggtttccctcccttccccaaaccatacagtngagaagt

SEQ ID NO: 12457 - DNA, 307 bp, Homo sapiens
  misc_feature 74: n = A,T,C or G
caaggagttttaaaagaaacctgacttctaagtgtgggtttttcttctctccaacataattatgttaatatggncctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtg

SEQ ID NO: 12458 - DNA, 334 bp, Homo sapiens
  misc_feature 14, 21, 44, 45: n = A,T,C or G
tcttgggcgcctgnaggaccnacactagtggatccaaagctttnntttgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattga

SEQ ID NO: 12459 - DNA, 320 bp, Homo sapiens
  misc_feature 15: n = A,T,C or G
ctgcagtattacctnaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaaga

SEQ ID NO: 12460 - DNA, 256 bp, Homo sapiens
  misc_feature 145: n = A,T,C or G
gtccgacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggntttctgctgccgcccgcaagcagagggactcggagatcatgcagcagaagcagaaaaaggcaaacgagaagaaggaggaacccaagtagctttgtggcttcgtgtccaacc

SEQ ID NO: 12461 - DNA, 308 bp, Homo sapiens
aacattgtatacaacatagccccaaatatagtaagatctatactagataatcctagatgaaatgttagagatgctatttgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggg

SEQ ID NO: 12462 - DNA, 377 bp, Homo sapiens
  misc_feature 7, 8, 38, 39, 66: n = A,T,C or G
cttgaannacccacactagtggatccaaagaaattctnnttcgagaacacatagactttatgagcnttatagtttttatgtttgtactccatctcttctgcaagtatattagttcagttgcatacatgtctgtgttcgtactactgttttcattcatccttccattaactcaacaaatagtgatttttacatggcaggcatggaaacagacttgtgaaatatcataatagagacctttgccatctcatgacctccagcttttccacttcaagtccgtgcttatagagcttttggccaaaaacttcatttgctcagttcattcttcagcttaaatgtctgttttgcacacgaagctatttacatttttgtttcatttg

SEQ ID NO: 12463 - DNA, 113 bp, Homo sapiens
cagaccggagtaatccaggtcggtttctatctacttcaaattcctccctgtacgaaaggacaagagaaataaggcctacttcacaaagcgccttcccccgtaaatgatatcat

SEQ ID NO: 12464 - DNA, 200 bp, Homo sapiens
  misc_feature 4, 7, 9, 25, 56, 70, 71, 78, 97, 140: n = A,T,C or G
ctcntgntngtatttcaccttaacngggttcatttaagcactcttgggaactccancacagtttctcttnngatgcantggtgtctaaggacggaangcactcctgcagggctccctgacccatcaaaggtacttcctgnagaatgcactcctgcagggcttcctgacctgtcaaaggtacttcctgtagaatgcactcc

SEQ ID NO: 12465 - DNA, 147 bp, Homo sapiens
aaaatacaaaaaattagctggatgtggtggtgggtgcctgtaatctcagctactcaaggaggctgaggcacaagaatagcttgaaccgggagatggaagatgcagtgagccaagatcacgcccctgcactccagcctgggcgacaga

SEQ ID NO: 12466 - DNA, 192 bp, Homo sapiens
gtgagggtgacgttagccttacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacttt

SEQ ID NO: 12467 - DNA, 157 bp, Homo sapiens
gatgaaaaagaaacatagttgtagtacttagcctacctagaccagcaagcattcatttttagctcgctcattttttaccatgttttccagtctgtttaacttctgcagtgccttcactacactgccttacataaaccaaatcacaataaagttcata

SEQ ID NO: 12468 - DNA, 372 bp, Homo sapiens
  misc_feature 269: n = A,T,C or G
ccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggnggaacttaaatagaaactggagatggctgcttcagccacagtcctaacctagaactgcattttaaagcaaactgataatgcagaaacaaactccttcgttaag

SEQ ID NO: 12469 - DNA, 353 bp, Homo sapiens
ggaatgttgacaattacttaaaatattttaagctcccttgctgaattcctgtcctgtccctgaggaatcagatggtcatacagccataggcacccacccgaaatttccctaggagttggagtaatgctagaattgaagaccttctgagtaaagggcttctctgccttctcagaggcaggagaatttgcactggttgtgttaaatgtataaaaagctatatgttcaccagtttactcatttccaatgtgtagatgaataaaatgtagtgtacaaattatttgaaaatcccagaaggaaggtaccttttcaaatacagtattttttttaacaaataaacttacgatttttacagc

SEQ ID NO: 12470 - DNA, 312 bp, Homo sapiens
  misc_feature 20: n = A,T,C or G
gtcctctgcctagaagcaangccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatg

SEQ ID NO: 12471 - DNA, 194 bp, Homo sapiens
  misc_feature 20: n = A,T,C or G
gtttgttcaacgattaaagncctacgtgatctgagttcagaccggagtaatccaggtcggtttctatctacttcaaattcctccctgtacgaaaggacaagagaaataaggcctacttcacaaagcgccttcccccgtaaatgatatcatctcaacttagcattatacccacacccacccaagaacagggtttt

SEQ ID NO: 12472 - DNA, 113 bp, Homo sapiens
  misc_feature 11, 21, 44, 55: n = A,T,C or G
ccattatctgnattaatgctngaatattactggataaattgtangaagatcttcngcagaatcagcatgatttttccaaggaaatacatatgcagatacttattaagagcaaa

SEQ ID NO: 12473 - DNA, 336 bp, Homo sapiens
  misc_feature 10: n = A,T,C or G
tggttgctgnaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtccca

SEQ ID NO: 12474 - DNA, 274 bp, Homo sapiens
tcgagggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcc

SEQ ID NO: 12475 - DNA, 259 bp, Homo sapiens
tcgagtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcat

SEQ ID NO: 12476 - DNA, 242 bp, Homo sapiens
  misc_feature 20, 115: n = A,T,C or G
ccaaaggctcctttttcaanacctctggaagccgcggttgaatgtgccatgaccctctccctctctggatggcaccatcattgaagctggcgtcatcggagtctcttgttctgtnggcgtgctacctggaagatccttctgtcctggacaagaggaattggaagagcattttatgttttaagaacaggctgacacgcagcagctacaacaacagctgagatcacttaataaatggtgctaaa

SEQ ID NO: 12477 - DNA, 400 bp, Homo sapiens
  misc_feature 4, 23, 38, 40, 42, 69, 95: n = A,T,C or G
tacnggggaaaaaaacccctggnttcttgggcgcctgnangnccccactagtggatccaaagaattctnttcgaggattttacatatccttggancaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttgga

SEQ ID NO: 12478 - DNA, 400 bp, Homo sapiens
  misc_feature 4, 14, 47: n = A,T,C or G
actngggcgcctgnaggtccccacactagtggatccaaagaattctnttcgagcagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacg

SEQ ID NO: 12479 - DNA, 384 bp, Homo sapiens
  misc_feature 15, 24, 176: n = A,T,C or G
tcgagcgagcctggngatagctgnctgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagnaggcctaaaagcagccaccaattaagaaagcgttcaagctcaacacccactacctaaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagc

SEQ ID NO: 12480 - DNA, 161 bp, Homo sapiens
  misc_feature 127: n = A,T,C or G
ctcctctgcctgggatgcgccctctgagaggaggcctagcagggcaggctccctctgggcatccctggatgcagcctctggacacatgcctcctttaaagtgtcccgggtgcagctcaaggttgagnggaggtagaaaggaaaaacaaaaatgtttaccac

SEQ ID NO: 12481 - DNA, 393 bp, Homo sapiens
  misc_feature 18, 222: n = A,T,C or G
aagtcactccccatcccnatcctccctactctctttagcctctgacaacgactaatctattttctatagtgtatctatggatttgccctttctggacatttacataaatcaaatcatgcattatgtggtcttttgtaactgctttcatttagcatattttcaaagttcatctatgttgcagcatgtgtcagcacttcctttgtatcattaatatttcattgngtgaatataccacattttgtttatcctttcatcagttgatggatatttgagctgtttccaccttttggctattgtgaataatgctgctgttaacattcatgtaaaagtgtttgtgtggatgaattgtttcatttctcttgggcagatacctaagagtgaaattgctgatta

SEQ ID NO: 12482 - DNA, 398 bp, Homo sapiens
  misc_feature 5, 9, 49, 73: n = A,T,C or G
ctccntggngcgcctgaaggcccgacactagtggatccaaagaaatttngcacgagaataaattgaactaaanccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaa

SEQ ID NO: 12483 - DNA, 396 bp, Homo sapiens
  misc_feature 21, 148: n = A,T,C or G
gtcatttcacagaggaggacnaggctactatcacaagcctgtggggcaaggtgaatgtggaagatgctggaggagaaaccctgggaaggctcctggttgtctacccatggacccagaggttctttgacagctttggcaacctgtcctntgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaaga

SEQ ID NO: 12484 - DNA, 375 bp, Homo sapiens
  misc_feature 113, 131, 133, 134, 175, 181, 229: n = A,T,C or G
acactagaaacatatgcaacgtgtttattacatacttctactggacatcacagaattctttgggttctttgtaatttaatgaataggtctgaaaacttatgaccaatacttgntataacttagaggacttngnnttattccaaataaggaatgaatttgcatttaaaatcttaangaatgntttcaaaactgaatagataacatagtactctaactaaagtctccaagntatgtattataatattacatagtagtatgcttaggctttactatgtattagccttttgttggactgtgtatgtattttaccatatgggttttaatgataatggggtatgactgctttacatgagtccttatgcatccagatgttat

SEQ ID NO: 12485 - DNA, 399 bp, Homo sapiens
  misc_feature 17, 27, 37, 39, 42, 45, 96, 223, 248: n = A,T,C or G
aaactgtgggaaaaaanccccttctanttggggcgcntnaanccncgacactagtggatccaaaaattttttcacgaggaaggacttcagcagccngaagaagtactgccaagtcatccgtgtcattgcccacacccagatgcgcctgcttcctctgcgccagaagaaggcccacctgatggagatccaggtgaacggaggcactgtggccgagaagctggantgggcccgcgagaggcttgagcagnaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtat

SEQ ID NO: 12486 - DNA, 389 bp, Homo sapiens
  misc_feature 53, 151, 153, 154: n = A,T,C or G
tcgaggaagcgcgaagagccgttcgtcatgccggtgtggtggcggcggcgganactgcgggcccgtagctgggctctgcgaggtgcaagaaagcctttgaggtgaaggtgtatgaaagtcatcataacagatgttttccaaaaacttgtananngttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaat

SEQ ID NO: 12487 - DNA, 397 bp, Homo sapiens
  misc_feature 10, 16, 33: n = A,T,C or G
gaaaaaaacncctgtntcttgggcgcctgaaanacccccactagtggatccaaagaaatttttttcgagctttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatcttt

SEQ ID NO: 12488 - DNA, 395 bp, Homo sapiens
  misc_feature 18, 148, 177: n = A,T,C or G
gatttgataagtgataancctctgtggttctgatcattggtccagaggggagataggttcctgtgatttttccttcttctctatagaataaatgaaatcttgttactagaacaagaaatgtcagatggccaaaaacaagatgaccatntttgatctcagcctgatgaccctacaggncgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttac

SEQ ID NO: 12489 - DNA, 335 bp, Homo sapiens
  misc_feature 21: n = A,T,C or G
cacaggcaaacccatcaagcngactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatcc

SEQ ID NO: 12490 - DNA, 400 bp, Homo sapiens
  misc_feature 32, 40, 44, 75, 99: n = A,T,C or G
actttctttgggaaaaaaccctgtctcttggngcgcctgnaggncccgacactagtggatccaaagaattctttnacgagcaaaaggaagctgtgtggnccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagagga

SEQ ID NO: 12491 - DNA, 400 bp, Homo sapiens
  misc_feature 18, 19, 111, 150, 154, 178: n = A,T,C or G
tcgagctacaccattggnnaggacatcattgacctcgtgttggaccgaattcgcaagctggccgaccagtgcacgggtctccagggcttcttggttttccacagctttggngggggaactggttctgggttcacctcgctgctcatggancgtntctcagttgattatggcaagaagnccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatca

SEQ ID NO: 12492 - DNA, 398 bp, Homo sapiens
tacgagagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagca

SEQ ID NO: 12493 - DNA, 119 bp, Homo sapiens
  misc_feature 97: n = A,T,C or G
ccaccctgggagagaacagaaagctgtccctggctgcgctttctcagccctgggaggggcgcctgaacccagaacatttccctaaccccaacctggnaggactcagccacttcttcagg

SEQ ID NO: 12494 - DNA, 398 bp, Homo sapiens
  misc_feature 2, 18: n = A,T,C or G
cncttggggcgcctgaangacccacactagtggatccaaagaattttttcgagaaaaaaaggaagtaaggcacaactgagactcatgggtgtggtctttgacagtgaaatcttttagctcttgcaagatcacatagaaaatttcaccaagttctaacatccagcaaaatggagaacatgtactggggacctttgggtttaaccagtgagattgtcttgtttatcctgttgcatttagccttccagcttatggaaaaatacaaaattcaaattctaacactgctggatttatgatatttaaggtttctattatatcagctgcctggatggagcacagaaacagcgtagtacaatatgctatgggtatattcatgaccaaagtttacaatgtggaaggag

SEQ ID NO: 12495 - DNA, 400 bp, Homo sapiens
  misc_feature 9, 25, 28, 225: n = A,T,C or G
acttactgngggaaaaacccccttntcnttggggcgcctgaaggcccgacactagtggatccaaagaattttttcacgaggaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactncggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctg

SEQ ID NO: 12496 - DNA, 400 bp, Homo sapiens
  misc_feature 2, 19, 28, 40, 98: n = A,T,C or G
cntacttgggaaaaaaacncctggtatnttgggcgcctgnaagtccccactagtggatccaaagaaattcttttcgaggtggttgctgccgaaatggncaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagaga

SEQ ID NO: 12497 - DNA, 345 bp, Homo sapiens
  misc_feature 7, 46, 47, 72: n = A,T,C or G
tcttggngcgcctgaaggcccacactagtggatccaaagaaatttnntacgagatcttgtgttgagacttcntggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacat

SEQ ID NO: 12498 - DNA, 398 bp, Homo sapiens
  misc_feature 2, 5, 28, 376: n = A,T,C or G
gnccnacactagtggatccaaagaattntttcgaggccaggctgatcttgaatccctgacctcagttgatcagcccaccttggcctcctaaagtgttgggattacaggtgtgaaccaccacgcccaacctcattgtagttttaattcacattccctgatgatgagtgggttgactatttttccatatacctgtcggccatttgtatgtcttcttttgagaaatgtctatttaggttctttgctcattttaaaatcaggttgtcttcttgctattgacttgtttgagttccttatatatttttgataatgatcccttatcagaagtgttgtttgcacatattttctccctctctgtaggtcatctttttactctgtngattgtttcttttgctgtgcag

SEQ ID NO: 12499 - DNA, 400 bp, Homo sapiens
  misc_feature 24, 27, 72, 99: n = A,T,C or G
cttactggggaaaaaacccctggnatnttggggcgcctgaaggacccacactagtggatccaaagaattctnttcgagtcagtttgaatattgcaggcnccatgaagtcttttcttgtagctattatgtacttgtgtgatgccatcaactagattataagtgccttgagcataggggttactataaattcatctttgtattctattgtacttagcttctcacataacaactaatataggataagtataatgagtttgttgaattaaattagattgatctgaattagaggggaggaattagacaatagaaaaacagggatgaacttagagaagctaagttttgtggtcatttgagataccttgttaatttagttttaagtaatcaagagtggtgatgtttt

SEQ ID NO: 12500 - DNA, 400 bp, Homo sapiens
  misc_feature 11, 13, 44, 70, 306: n = A,T,C or G
tgggcgcctgnangacccacactagtggatccaaagaaattctnttcgagcatcatctctgccccctctnctgacgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccanaacatcatccctgcctctactggcgctgccaaggctgtgggcaaggtcatccctgagctgaacgggaagctcacttggcatggccttccgtgtc

SEQ ID NO: 12501 - DNA, 218 bp, Homo sapiens
gctgatccatgaggtcctagcccctggctgcctggatgcgttccccctgctctcagcatatgtggggcgcctcagcgcccggcccaagctcaaggccttcctggcctcccctgagtacgtgaacctccccatcaatggcaacgggaaacagtgagggttggggggactctgagcgggaggcagagtttgccttcctttctccaggaccaataaaattt

SEQ ID NO: 12502 - DNA, 328 bp, Homo sapiens
  misc_feature 2, 7: n = A,T,C or G
tncggcncgagacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatataggttttgcttccttctggtgtt

SEQ ID NO: 12503 - DNA, 162 bp, Homo sapiens
gtggactgtcccccacccccaccccatcattgtttttaaaaaattaaggcctggcgcagcagctcatgcctataatcccagcactttgggaggctgaggcgggcggatcacttgaggccaggagtttgagaccagcccaggcaacatagcaaaaccccattc

SEQ ID NO: 12504 - DNA, 207 bp, Homo sapiens
  misc_feature 2, 14, 25, 36, 53, 100, 105, 140: n = A,T,C or G
cngacttccattcnaaggaccctgngcttcccaagnggccatcttcaactttngcacttgaattcaactctcttcaaactagtttctggccaggcatggnggctnatgcccgcaatcctggcactttaggaggctgaggngggaggatcacttgaggccaggaatttgagaccaacctggacaacataatgagacctctgtctctac

SEQ ID NO: 12505 - DNA, 343 bp, Homo sapiens
  misc_feature 6, 16, 49, 72, 193: n = A,T,C or G
tcttgngcgcctgaangccccacactagtggatccaaagaaattttttncgagtggtggctcactcctgtantcccagctcattgggactccaaggcgggtattatcatctgaggtcaggagttggagaccagcctggccaacatggcagagccctaactctactaaaaatacaaaaattagcagggcacagnggtctgcgcctgtaatcccagatactcgggaggctgaggcaggagaatcacttgagccctggcagcggaggttgcagtgagctgggattgcgcctttgcactccagcctgggcgacagagcaagactccatctcaaaaaacaataataat

SEQ ID NO: 12506 - DNA, 357 bp, Homo sapiens
  misc_feature 11, 12, 42, 194, 195: n = A,T,C or G
gcgccctgaannccccacactagtggatccaaagaaattttntacgaggccttacattttgacgttctgttcttctgaactgtaaatatctgccaaattatttcaccaagaagacttgtttgtttagctcctgtagcatcttcagtgcttgtaacatgttcttacggtgccctgtcactgcatcgtttagctgnnctggaattccttgtaccacgtctctaccttctgatgtacaactatttatcacctgtacctctcatgtgccctgtttccaagagaaacgagttctgtttaaagagaatttgtatatttgatactattctttaagtgtactgctaacccttcctttccttttga

SEQ ID NO: 12507 - DNA, 364 bp, Homo sapiens
  misc_feature 23, 50, 178, 179, 205: n = A,T,C or G
acactagtggatccaaagaattnttttcgagcggcatttctgtggatccnaggaggcggaacacggagtccctgcaggccaacgtgcagcggctgaaggagtaccgctccaaactcatcctcttccccaggaagccctcggcccccaagaagggagacagttctgctgaagaactgannctggccacccagctgaccggaccggncatgcccgtccggaacgtctataagaaggagaaagctcgagtcatcactgaggaagagaagaatttcaaagccttcgctagtctccgtatggcccgtgccaacgcccggctcttcggcatacggggcaaaaagagccaaggaagccgcagaacaggatg

SEQ ID NO: 12508 - DNA, 179 bp, Homo sapiens
  misc_feature 67: n = A,T,C or G
aaattttgaattagctttcctatgaagtgccttaagtagactcttcatttacttttctggtaatggnttaaatatcatttgttatgcatttttaagatacagttcagaatgacacattgtagtggcaaagataaccaaatgtctggctgtttgctttttgaccatatcaataaactttt

SEQ ID NO: 12509 - DNA, 396 bp, Homo sapiens
  misc_feature 19, 21, 149: n = A,T,C or G
gtctgtacagccaacggtncncccttgggggctttgaaataacaccaccagtggtcttaaggttgaagtgtggttcagggccagtgcatattagtggacagcacttagtagctgtggaggaagatgcagagtcagaagatgaagaggangaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaag

SEQ ID NO: 12510 - DNA, 339 bp, Homo sapiens
  misc_feature 9, 325: n = A,T,C or G
ttcggcacnagaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgngcctatgcgtgatg

SEQ ID NO: 12511 - DNA, 395 bp, Homo sapiens
atctggctggacttccagcagtacctgagcaagaccagcaagtacctcaccgactcggaatacacagagggctccacaggtaagacgtgcctgatgaaggctgtgctgaaccttaaggacggggtcaatgcctgcattctgccactgctgcagatcgaccgggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagca

SEQ ID NO: 12512 - DNA, 380 bp, Homo sapiens
  misc_feature 376, 379: n = A,T,C or G
gtttctggggcccgctgcgcgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggnggng

SEQ ID NO: 12513 - DNA, 284 bp, Homo sapiens
  misc_feature 283: n = A,T,C or G
ctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacnt

SEQ ID NO: 12514 - DNA, 400 bp, Homo sapiens
  misc_feature 24, 152, 153: n = A,T,C or G
tcgagcaaccaggagtcctaattnccgatcttctataaacccattgctgtaagtaaagctagaagtcagttgggctccgtttctaccaatgtcctcaatattaagtgtttacactgtgctaccttaagaatagcaatacagttatgacagtnntgatgctaataacaatgtttgaatatttttcccctccaaaactcatgttgaaatttaatctctaatgtggcagtattgaaaggtcggagactttaggggtgattagatcatgagggctctgccttcatcaattgattaatccattcaattcatgaatgaatggattcatggattaatgaattaagggattataatgagaggtaaacttgtggctttaaaggaggacaaagagagacctgggctagtg

SEQ ID NO: 12515 - DNA, 283 bp, Homo sapiens
  misc_feature 19, 144: n = A,T,C or G
gggagagaggctttggtgncttggaggaaggactgtgtccctccttagggcgtctgtggcctcagtgagggaaggaagctgcatcagacaggggtttcctcgctgtccacccctctggcagaagatggattgggctgccccgtntaaattaatgaaaagattaaagtttcgctaaaggggacatcgagtttatgtgtcatctcctggtgtctgtgtgcctgggatctgcaatatatcccagcccttgatgtactgtttctataaaaataaattacttgtaatt

SEQ ID NO: 12516 - DNA, 344 bp, Homo sapiens
  misc_feature 13, 19: n = A,T,C or G
gcctaatgctccntaccgnatcttcaacacctggcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtg

SEQ ID NO: 12517 - DNA, 327 bp, Homo sapiens
  misc_feature 136, 147: n = A,T,C or G
ttcggcacgagaatttgtgcaatgttagattttcttatcaatcaagttcttgaatttgattctaagttgcatattataacagtctcgaaaattattttacttataaatcatttgacctacctaattgctaaatgantaacatatggnggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttat

SEQ ID NO: 12518 - DNA, 400 bp, Homo sapiens
  misc_feature 151: n = A,T,C or G
tcgagggtgctcggtccttccgacgaagctaaggctgcgttggggtgaggccctcacttcatccggcgactagcaccgcgtccggcagcgccagccctacactcgcccgcgccatggcctctgtctccgagctcgcctgcatctactcggncctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagc

SEQ ID NO: 12519 - DNA, 395 bp, Homo sapiens
  misc_feature 146: n = A,T,C or G
gaaattttggaggcagaagctctggcccctatggcggtggaggccaatactttgcaaaaccacgaaaccaaggtggctatggcggttccagcagcagcagtagctatggcagtggcagaagattttaattaggaaacaaagcttancaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttt

SEQ ID NO: 12520 - DNA, 315 bp, Homo sapiens
  misc_feature 150: n = A,T,C or G
ataattcaagcactgcttattacaattttactgggtctctattttaccctcctacaggcctcagagtacttcgagtctcccttcaccatttccgacggcatctacggctcaacattttttgtagccacaggcttccacggacttcacgtnattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcttaaaag

SEQ ID NO: 12521 - DNA, 391 bp, Homo sapiens
  misc_feature 13, 30, 38, 42, 68: n = A,T,C or G
ctttcttgggaanaaacccctgtacttggngcgcctgnaggncccacactagtggatccaaagaattnttacgaggggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctc

SEQ ID NO: 12522 - DNA, 400 bp, Homo sapiens
  misc_feature 24, 27, 51: n = A,T,C or G
acactagtggatccaaagaaattnttnacgagaatacatttaattgcattncttcttgttgattgaataaatatacttaaatacatatctttctgttaatattgtctacaagtgtatttttaataggggatgtattttacatgtcattaccttaaatgtcattatataccatgctgctgcgtcatggtttgtatgattgtttccccattttgaagcattgttttcaatttcattattttataatgaaatgtaatatttcttggtataaattaatttcttttttccccaagttacttctttgaaattactgcgtttgaacagctcttattaaaggctgctagatcatttaaagaaagattgaagttggtttcattgccagcagtgtgtacctgtttatcta

SEQ ID NO: 12523 - DNA, 303 bp, Homo sapiens
  misc_feature 19: n = A,T,C or G
ctgtggaatcgaatcagangtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtaga

SEQ ID NO: 12524 - DNA, 395 bp, Homo sapiens
ggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgagg

SEQ ID NO: 12525 - DNA, 124 bp, Homo sapiens
  misc_feature 3, 5, 44, 59, 65, 80, 101, 102: n = A,T,C or G
gcncnttaaaaccttaagatctctattatttttaaaattaaaanatgtgaaggagttantaagtnattctttgagaaaanttatgtacattaaaaaaggcnnaaaaaccgggactgctggcaag

SEQ ID NO: 12526 - DNA, 100 bp, Homo sapiens
  misc_feature 47, 63, 66, 69, 72: n = A,T,C or G
ggtgttctggattcccgtagaaacttaaagggaaattttcacaatgnccggagcccttgatgnccngcnaangaaggaggaggatgtccttaagttcctt

SEQ ID NO: 12527 - DNA, 102 bp, Homo sapiens
  misc_feature 13, 20, 42, 45, 52, 83: n = A,T,C or G
ctgcaagacgctnagatgtngaagcctaagaagaaccggttngcnatttatnaactcctttttaaggagggagtcatggaggncaagaaggatgcccacatg

SEQ ID NO: 12528 - DNA, 100 bp, Homo sapiens
  misc_feature 1, 3, 5, 7, 16, 63, 66, 70, 71, 90, 93: n = A,T,C or G
ntngngncctgaccancttcaaaaatatactttactgccctgaaaaacagacacagggagagntgnttgnntcttcacttggccaaatgnaanagaagaa

SEQ ID NO: 12529 - DNA, 128 bp, Homo sapiens
  misc_feature 9, 12, 28, 33, 77, 81, 99, 108, 124, 126: n = A,T,C or G
ccaaatcanaancgaaaaaatcagcgantaaancatcattttgccactaccccctcctgaagccacagcagggtttnaggntacaatcagaactggtgncaaggtganatttccatgcataaangnga

SEQ ID NO: 12530 - DNA, 113 bp, Homo sapiens
  misc_feature 4, 9, 42, 45, 57, 64, 66, 75: n = A,T,C or G
aacnggccnagtaagggccttactccttcacagatcggtganatnctgaaaggattnacatggngntgcacaagnacgctttgtgacaggcaataaaattttaagaattctta

SEQ ID NO: 12531 - DNA, 118 bp, Homo sapiens
  misc_feature 8, 37: n = A,T,C or G
ctccgcgngcccccagtaggacactagaggatccaantaattcgcacgagctcgtgcagcgcctgagtgcccgtcaaaagcttaaggccttcctgtgctcccctgagtacgtgaacct

SEQ ID NO: 12532 - DNA, 214 bp, Homo sapiens
gaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttg

SEQ ID NO: 12533 - DNA, 237 bp, Homo sapiens
ttcggcacgagtagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactat

SEQ ID NO: 12534 - DNA, 139 bp, Homo sapiens
aaaataacagcttatttaagcaggaacaagagaactaagggaggtctgtgcattttaaacacaaatgtgaagaacttgtatataaacaaaagtaaatactataatacaaacttccttctgaaataaaagtagatctggt

SEQ ID NO: 12535 - DNA, 124 bp, Homo sapiens
  misc_feature 3, 13, 14, 19, 20, 21, 43, 46, 78, 95, 103: n = A,T,C or G
canatgggccccnnactgnnnggcacacatgaagggcagcccnggnccccacaggatctgcgacagtacaaccacatntcctgcgactacagganttctacanatagattttcacacttagaag

SEQ ID NO: 12536 - DNA, 203 bp, Homo sapiens
  misc_feature 92, 105, 195: n = A,T,C or G
aaggagtagggcacagggacatctttctttgagtgaccgtctgtgcaggccctgtagtccgccacagggctctgagctgcactggccccggngctggcatctggnggagcggacccactcccctcacattccacaggcccatggactcacttttgtaacaaactcctaccaacactgaccaataaaaaaaaatgngggttttt

SEQ ID NO: 12537 - DNA, 330 bp, Homo sapiens
  misc_feature 263, 270, 304: n = A,T,C or G
ggaaaagtcacttaagatagtattaagtaattaaattcctatgtccgttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgntttaagntgaagttacttcatggatgtcatacccatgaagngcatttggatgagatagaagaaattg

SEQ ID NO: 12538 - DNA, 339 bp, Homo sapiens
  misc_feature 106, 277: n = A,T,C or G
gaaacctcatagttattcttgactccaggaagaaatattattgagtttttaaaaactcagcttattgactcattgttttatataataaaatgcaacagttttaagngtatatttcaatgagttttaatacatttatgtacttgtgtcactatcctcatagatagagacaaaacatttctatcacaccggcaatttcctatgtgtcccatcccaatcaatcctttcccctttgctggctccaaacaatgactctttcctatctttttagaaagattanaattgcttttctagagttccagtaatggaatcatacagtgtctaagtctgtttgtggggctg

SEQ ID NO: 12539 - DNA, 285 bp, Homo sapiens
ggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacg

SEQ ID NO: 12540 - DNA, 339 bp, Homo sapiens
  misc_feature 229: n = A,T,C or G
aagttctgtaatttggagcagagtgctatagttctttggggtatgtcttctcttttgcctcatccacttgccaggtagcagtggctttttattcttaagtcttagagatgcatttagagttacatacagacatatggtggaaaggggtcttgagttgatttggggcaaaaggcaaccgtccccatgcactagagatgaatcatgcctacctccctttgtcatgggaagnggcggccactgccacatctgctatgaggctcttcgccatcgttggctgctggaaatttggatacaggtaaatggtatataaggcttctttttgcttgtgcaccagaagtc

SEQ ID NO: 12541 - DNA, 325 bp, Homo sapiens
  misc_feature 202, 307: n = A,T,C or G
ttcggcacgaggtcctacaagaggcaggcggaggaggctgatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagngagccagcccttctggagcaggacagaagatatgcaaaatgtatattttcttgattcctgaccattgatacttaatgtccatgtgactcttttttcacatgcaanaaactttgcttttgtttc

SEQ ID NO: 12542 - DNA, 234 bp, Homo sapiens
gctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagac

SEQ ID NO: 12543 - DNA, 337 bp, Homo sapiens
gtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaag

SEQ ID NO: 12544 - DNA, 239 bp, Homo sapiens
  misc_feature 41, 148, 168: n = A,T,C or G
ttcggcacgagggtctcagaactgtttgtttcaattggccntttaagtttagtagtaaaagactggttaatgataacaatgcatcgtaaaaccttcagaaggaaaggagaatgttttgtggaccactttggttttcttttttgcgtgnggcaggttttaagttattangtttttaaaatcagtactttttaatggaaacaacttgaccaaaaatttgtcacagaattttgagacccatt

SEQ ID NO: 12545 - DNA, 283 bp, Homo sapiens
tggcctcccaaagtgctgggattaccggcgtgagccaccgcgcccagcctagagctgctttatttttattttattttaattttttttgagacggcgtttcactctgtcaccacacaggactgcagtgagccgagattgcaccactgcactccagcctgggcaatagagcgagactgtttctgggagaaaaaaagaaattagccacgcatgggggcatacacctgcagtctcagctacccaggaggctgaggcgggaggatcacttgagcccaggagttcaagg

SEQ ID NO: 12546 - DNA, 191 bp, Homo sapiens
gtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttctt

SEQ ID NO: 12547 - DNA, 250 bp, Homo sapiens
  misc_feature 80, 143: n = A,T,C or G
gctctccgacctctctcctctgaaaccctcctccacagctgcagcccatcctcccggctccctcctagtctgtcctgcgncctctgtccccgggtttcagagacaacttcccaaagcacaaagcagtttttccccctaggggngggaggaagcaaaagactctgtacctattttgtatgtgtataataatttgagatgtttttaattattttgattgctggaataaagcatgtggaaatgacccaaacat

SEQ ID NO: 12548 - DNA, 273 bp, Homo sapiens
  misc_feature 272: n = A,T,C or G
tggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacacgtttatgttacttctatttgaatttctatatttcccatgtgggttttatgtttaatattaggggagtagagccagttaacatttagggagttatctgttttcatcttgaggng

SEQ ID NO: 12549 - DNA, 331 bp, Homo sapiens
  misc_feature 137: n = A,T,C or G
attaacatcctttgcccatttttgaattggattatttgtctttttattgctgagttgtaagagttctttatgtttgggatacaagtcccttatcggatacatgatttacaaatattttctgccattctgtgggttgncttttcagtttcttggtagtgttgtttgcagcacaagtgtctttaattttgattctctagtttcttaatttatatagttgtttaaactctgaaactatatgttttattgagattattttcctctgtgctcattctgtactttctcccatgttcatatagctctctctttcccgggacgttttctagcctcaaag

SEQ ID NO: 12550 - DNA, 305 bp, Homo sapiens
  misc_feature 223, 285: n = A,T,C or G
caagttgtgagtgacagtgggaaagggtccaattgccactgaggacaccaggcaataaatcatcctcccctggcatcagctggctggacgaatccccacttcctgagtaagtaccagggcctagatgtgacaaaacagctattgtcagctcctagtggccacattcccactttctctctactgagattttccgtttactcgagagtacttctagagcggccgngggcccatcgattttccacccgggtggggtaccaggtaagtgtacccaattcgccctatagngagtcgtattacattcactg

SEQ ID NO: 12551 - DNA, 290 bp, Homo sapiens
  misc_feature 197, 202, 288: n = A,T,C or G
ttcggcacgaggagatgacgaagggaacgtcatcgtttggaaagcgtcgcaataagacgcacacgttgtgccgccgctgtggctctaaggcctaccaccttcagaagtcgacctgtggcaaaatgtggctaccctgccaagcgcaagagaaagtataactggagtgccaaggctaaaagacgaaataccaccggaanctggncgaatgaggcacctaaaaattgtataccgcagattcaggcatggattccgggaaggaacaacacctaaacccaagagggcagctgntg

SEQ ID NO: 12552 - DNA, 341 bp, Homo sapiens
  misc_feature 37: n = A,T,C or G
tctgagattaccttcttgccctttccaacaccttagngattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccagg

SEQ ID NO: 12553 - DNA, 331 bp, Homo sapiens
aaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcataccc

SEQ ID NO: 12554 - DNA, 307 bp, Homo sapiens
ctcgtgccggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctc

SEQ ID NO: 12555 - DNA, 304 bp, Homo sapiens
gacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 12556 - DNA, 286 bp, Homo sapiens
  misc_feature 65: n = A,T,C or G
aaacattgaacagtttgaattttgccaagttggacattaaagtaaaaatgaagtgaaatcctgcnttgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgg

SEQ ID NO: 12557 - DNA, 306 bp, Homo sapiens
  misc_feature 306: n = A,T,C or G
gagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcaggggaatgcagcccctgggactggggaggtcccttggcagtcgcctgctgcccagtgtgaccagaaaggcagccctgtccccccatan

SEQ ID NO: 12558 - DNA, 341 bp, Homo sapiens
  misc_feature 108, 111, 329: n = A,T,C or G
cctaatccagttataataaaatcaattaaatgaaatattctatagaatcgatctatgcccttgttaatctccatccatataggagtcacgttctttaagacagatggnggnagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgnataaaagtacag

SEQ ID NO: 12559 - DNA, 358 bp, Homo sapiens
  misc_feature 2, 85, 357: n = A,T,C or G
gntcccttaagcaaaattgaatttgctttgaacttttagttatgcacagactgataataaacctctaaacctgcccagcggaagngtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttagggcataagnt

SEQ ID NO: 12560 - DNA, 351 bp, Homo sapiens
ggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggc

SEQ ID NO: 12561 - DNA, 362 bp, Homo sapiens
  misc_feature 213: n = A,T,C or G
gtggatccaaagaattcggcacgagagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggncgaatgaggcacctaaaaattgtataccgcagattcaggcatggattccgtgaaggaacaacacctaaacccaagagggcagcttgttgcagcatccagttcatcttaagaatgtcaacgattagtcatgcaataaatgttctggtttt

SEQ ID NO: 12562 - DNA, 239 bp, Homo sapiens
gttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttg

SEQ ID NO: 12563 - DNA, 154 bp, Homo sapiens
  misc_feature 5, 11, 13, 18, 34, 54, 61, 70: n = A,T,C or G
ctcgngccgantncggcncgagctgcaacctggntgccatcaaagtcttctgcnacatggngactggggngacctgcgtgtaccccactcagcccagtggggcccagaagaactggtacatcagcaagaaccccaaggacaagaggcatgtctg

SEQ ID NO: 12564 - DNA, 205 bp, Homo sapiens
  misc_feature 27: n = A,T,C or G
cgccgccggacctacagagctcatggncggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaatt

SEQ ID NO: 12565 - DNA, 349 bp, Homo sapiens
  misc_feature 70, 106, 337: n = A,T,C or G
cttcagaaacatccctggaattactctgcttaatgtaagcaagctgaacattttgaagcttgctcctggngggcatgtgggacgtttctgcatttggactgaaagngctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcnaagaccatgcgc

SEQ ID NO: 12566 - DNA, 355 bp, Homo sapiens
  misc_feature 110: n = A,T,C or G
caacctggccagcttccccaagatgtgactccagccagccaaatccatcctgctcttccatttcttccacgatggtgcagtgtaacgatgcactttggaagggagttggngtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggt

SEQ ID NO: 12567 - DNA, 353 bp, Homo sapiens
gccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgta

SEQ ID NO: 12568 - DNA, 104 bp, Homo sapiens
agtacttctagagcggccgagggcccatcgattttccacccgggtggggtaccaggtaagtgtacccaattcgccctatagtgagtcgtattacaatttcactg

SEQ ID NO: 12569 - DNA, 290 bp, Homo sapiens
gtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcggccggatga

SEQ ID NO: 12570 - DNA, 188 bp, Homo sapiens
ttcggcacgagcaagggtagtgtaaagtgttttgtgtaaaatatcagacccctatccagagtaccagaaggaaagctcactacttcttccctttgattctcttccctcttcctacacagacttaatgaagacatctgcctgacaatattcagcttgtcaaattagacaagaaacagccaaatctgcct

SEQ ID NO: 12571 - DNA, 167 bp, Homo sapiens
  misc_feature 9, 126: n = A,T,C or G
cctctgccncgtggaccgcgcgcggggcgctccctggtggcgatggcgcggcactggccgagcactgcgggggctttcctccttgttggttgctgagtgggcggccaaggggagaaaaggagccgnttctgcctcccttgccaaaactccgtttctaattaaattat

SEQ ID NO: 12572 - DNA, 351 bp, Homo sapiens
  misc_feature 2, 24, 183, 298, 336, 338: n = A,T,C or G
gncaaaagtagatttggtcactgngatagtatgagggttagcagtggtttctttcctgtgctggctgcttagctatctctgtcattctgtgggaagctctagttttaacatagtttgaggagctcagagacacttccctagatgtaaaaatcactaaatagatgatcttctttgctgttcagntgtaataaggtatttctattagatatattttccctccaaggatttagatgataatttatgtgcatttaaatacgtgtaaaccttgggacctttctcagttatacaaggccgcagnaaatattttactaaggaatcataacagggatggctagngntttatatgtatta

SEQ ID NO: 12573 - DNA, 365 bp, Homo sapiens
  misc_feature 141: n = A,T,C or G
gggtgagctctgcccggctgcagggatggcggggaggggtaagctcatcgcagtgatcggagacgaggacacggtgactggtttcctgctgggcggcataggggagcttaacaagaaccgccatcccaatttcctggtggnggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttca

SEQ ID NO: 12574 - DNA, 329 bp, Homo sapiens
  misc_feature 71, 78, 144, 167, 174, 203, 261, 282: n = A,T,C or G
ttcggcacgagcaatttacaaagttatttcaagtttattcatttcactcctgtatgtatacatatatatgngtgtacntacacatatacagaatctactatgtttagacaagattctagacactgtaaataattagtaaagtgngaacactttactaagtattaagnactaagntaacactttttttttactaaatactaagnaaacactttactaagtaaataccttagtaaattactcatatttactagtaatactagnattactagtatttactaaagnattactaatactagtattaataaatactaagttcctgacctcgagag

SEQ ID NO: 12575 - DNA, 337 bp, Homo sapiens
atgcattagtatcacccaagaactgcaaattctcacacattataccagatcagcagaatcagaaattctaggggtagagcccagcaatctgtctttaaatagcctatcaggtgattttaacacacactgaatttcagcctgaatcttgaaactctagattaggttgggcacagagcctccagctttcctcagctaccacagcttccttttatccattttaaagtagtttcctgtttatctgttttaaaattcaccttctcacacttacttgtttttaaattgaacatccaagattttacacagctcagctccttggtttcttagaattgaaggcact

SEQ ID NO: 12576 - DNA, 286 bp, Homo sapiens
gtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcggtggcttacaactgtaatcctggcaatatggcaagac

SEQ ID NO: 12577 - DNA, 359 bp, Homo sapiens
  misc_feature 298: n = A,T,C or G
caggaaatgcaatatgactacaatttagaggaggacacacagagataccagctagcaaatgctgggtgtgcctgggaatgagtaattcacaagaatgttcaaggaaggaatatgatcgatataggacaggagaaagggcttttcaattaaaaagtagggcacagaaacatgagcacatttagggaaaggcaaattcatacaatatgtggacaaaattagatggaaatattatgttgagtcacatgaaattgtaatatttgattactattttttaccaaaaacactggcagttccatgnggattcacctaatatactcagtgaacaagcatttgtggagtgcctgttttgcaggtacaat

SEQ ID NO: 12578 - DNA, 122 bp, Homo sapiens
  misc_feature 38, 101: n = A,T,C or G
gagagaactagtctcgagagtacttctagagcggccgngggcccatcgattttccacccgggtggggtaccagggtaagtgtacccaattcgccctatagngagtcgtattacatttcactg

SEQ ID NO: 12579 - DNA, 227 bp, Homo sapiens
cggtctcagaactgtttgtttcaattggccctttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccatt

SEQ ID NO: 12580 - DNA, 362 bp, Homo sapiens
  misc_feature 13, 51, 73, 76, 233, 302, 305, 306, 341, 346, 360: n = A,T,C or G
atgaggtgcaggntacttcactctttttttttcttttttgagacagagtcncacctattgcccagactgaagngcngtggtgcgatcatggatcactgcagcagcatcctcgagttcaagctatccttccacctccgcctcctgagtagctgggaccacaggttcacataaccatgcctggctaatttatttttacttttattttaaaataaaagatgaggtctgtcttatgntgcccaggctggtctcaaactatcctacttcttcctcccaaagtgttgggattataggtgtgagccacntgnncccagcctacttcactcttctgaattattctgatntattntcaacaacttttgnga

SEQ ID NO: 12581 - DNA, 234 bp, Homo sapiens
cacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagc

SEQ ID NO: 12582 - DNA, 350 bp, Homo sapiens
tggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggtatgtagtgctgcagcccccttctcccacctttgccccaggcctcctgactcagttctttccattgctccttagatccacatctcaaagaagtgggggcttcaccaagttcaatgctgatgaatttg

SEQ ID NO: 12583 - DNA, 104 bp, Homo sapiens
  misc_feature 20, 50: n = A,T,C or G
agtacttctagagcggccgngggcccatcgattttccacccgggtggggnaccagggtaagtgtacccaattcgccctatagtgagtcgtattacaattcactg

SEQ ID NO: 12584 - DNA, 363 bp, Homo sapiens
cagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctg

SEQ ID NO: 12585 - DNA, 121 bp, Homo sapiens
tgcctatagtcttagctaattgggagactgaggcagaagaattgctttaacccagtaggcagaggctgcagtgagccaagatcgtgccactgcactccagccagagcgagactctgtctcc

SEQ ID NO: 12586 - DNA, 173 bp, Homo sapiens
  misc_feature 24: n = A,T,C or G
cttttttaattttatgaaaattgngtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatat

SEQ ID NO: 12587 - DNA, 354 bp, Homo sapiens
  misc_feature 174, 207: n = A,T,C or G
cttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggngatcagaatcagaagttcggatttgaagttggncctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatt

SEQ ID NO: 12588 - DNA, 177 bp, Homo sapiens
  misc_feature 113: n = A,T,C or G
aaatcgatcatatctttgaactttttctgagcaaagcaagaccttaacatctttaccataccatcttttacttccctgtgccctagaccaggggtcggcaaactgcaatctgngggtcaaatgcagtccataaccagtttttcatacagccctagagccaagaacagttttgatatt

SEQ ID NO: 12589 - DNA, 145 bp, Homo sapiens
  misc_feature 2: n = A,T,C or G
gnggccttggaaagggccacaagttccaccacactattggtggctctcgccgggcagcttggagaaggcgcaatactctccagctccaccgttaccgctaatataagtaaagtttgtaaaattcatacttaataaacaatttagg

SEQ ID NO: 12590 - DNA, 188 bp, Homo sapiens
gccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctgg

SEQ ID NO: 12591 - DNA, 400 bp, Homo sapiens
  misc_feature 2, 4, 27: n = A,T,C or G
tnantgcgacactagtggatccaaagnttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactg

SEQ ID NO: 12592 - DNA, 121 bp, Homo sapiens
  misc_feature 17, 121: n = A,T,C or G
caaaaagtgaaatttgncataaagaatttcttttatttttgaaatcgagtttgtaaatgtccttttaagaagggagatatgaatccaataaataaactcaagtcttggctacctgaaaaan

SEQ ID NO: 12593 - DNA, 226 bp, Homo sapiens
  misc_feature 10, 11, 14, 163: n = A,T,C or G
ctcgtgccgnnttnggcacgagaacaacttaaatattctgggagagaataataattatgcttttatataaatgtgtttagcgggggaaaaaaaggctctacctggctatgaaaccttgagcaagtagaaatcctaccagtgcagatattctgaggattctttntttattcttattttcacttttattttttgagatagtcttgctttgtcgcccaggctggagtgc

SEQ ID NO: 12594 - DNA, 148 bp, Homo sapiens
aagacagtggctggcggtgcctggacgtacaataccacttccgctgtcacggtaaagtccgccatcagaagactgaaggagttgaaagaccagtagacgctcctctactctttgagacatcacctggcctataataaatgggttaatt

SEQ ID NO: 12595 - DNA, 116 bp, Homo sapiens
  misc_feature 46, 71, 73, 86: n = A,T,C or G
gcgaaactccatctcaaaaaaaaaagaaagaaagaaagaaagaaanggcggttaccatctgtttcttctgngngagacatgggagnctaactgaagtctctccttcctaataaatg

SEQ ID NO: 12596 - DNA, 361 bp, Homo sapiens
  misc_feature 168, 216: n = A,T,C or G
cccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggngctagaagaatttgagaagaaatactcctgtattgagttgtatcgtgnggtgtattttttaaaaaatttgatttagcattcatattttccatcttattcccaattaaaagtatgcagattatttgcccaaatcttcttcagattcagcatttgttctttgccagtctcattttcatcttcttccatggttcca

SEQ ID NO: 12597 - DNA, 363 bp, Homo sapiens
tgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaag

SEQ ID NO: 12598 - DNA, 341 bp, Homo sapiens
  misc_feature 2, 99: n = A,T,C or G
gntttaagttgcatgaaaccattaatagccttgaaagctttgataagttttcagtaataataacctatttaatcagatgatgatgtgtttgaaaatagngttcaatatcagcaaatttgtacacagggaatgtaaataaggataactgatcagagttatccactgtatttataaggaagagtcggaaaaaaacaatgaccttagttttttttaagcctgatgatactatggtttactctaataagatagctatattgataattatatttttgttactgtgcccttgcacattttgggctttttgttaatatttttattaataacacataattagtaaccac

SEQ ID NO: 12599 - DNA, 358 bp, Homo sapiens
cgtccgcgtcgctagctagtcgttctgaagcggcggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctca

SEQ ID NO: 12600 - DNA, 133 bp, Homo sapiens
gaattatcatcccaacagccaagacccaacaggtgctgaactgtgcatcaaccaggaagagttctatccccaagctggccactatcacatatgcttactcttgcttaaaattaataaatcatgttttgatgag

SEQ ID NO: 12601 - DNA, 265 bp, Homo sapiens
  misc_feature 149: n = A,T,C or G
ccgaattcggcacgagtagtgacttaattaaatgagttaatatgtgagactgtgtagcagcgagtctgtacatcccggacacttcataaatattaatttccttttctttaattttaggggcttatttttcatgaacagtgccgagagcnccaagattccacaggaaaacatttttttctttaaaaaacaaactttaatttctttgatgatcaaagaaaagtcacccatgagtcagtgctgaaactgtgtaaaagaacaatagata

SEQ ID NO: 12602 - DNA, 348 bp, Homo sapiens
  misc_feature 167, 205: n = A,T,C or G
ggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgnggaaatccacgggaccaaatttctgcagaggccttgcnggatggttccataactgtagagtctaattgctatccattacagaaattaatcgttcagttgaaagaagtactgatgacttttcaaaacaaatgaaccaccgtagctgacagagaaccgtatcgtagaggtttgtaggttagtg

SEQ ID NO: 12603 - DNA, 355 bp, Homo sapiens
ctgcaatccagccctggccgcgggaggggccatctctggccaatgctgctgtgccttcaaggactgacaagttacgtaggggcagaggtcgccagctagccagtgtctcctccatctggggggcgtctgtccacttgtcaccttaggttttcactcatttgtcaccttggggttttgctctgtgtgtttcatatccaacggcaatacttgcagggggacagagtcctctaaatactccaatcctgcggtttttacaaacataaagggggagaccccaagtggaggaccctgggcctggagctccctcccaaactttgtccagcatccagcctgttccctgggctcactggggagg

SEQ ID NO: 12604 - DNA, 353 bp, Homo sapiens
ggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaag

SEQ ID NO: 12605 - DNA, 332 bp, Homo sapiens
  misc_feature 133: n = A,T,C or G
gtggatccaaagaattcggcacgaggacaagaagactgtcaggaagggtcggagtctgtaaaaccagcatacagtttggcttttttcacattgatcatttttatatgaaataaaaagatcctgcatttatggngtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaag

SEQ ID NO: 12606 - DNA, 355 bp, Homo sapiens
  misc_feature 240, 258: n = A,T,C or G
ggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgncttcctgtaagaccttcgggtcaaggcagaggcaggaaactaactggtgtgagtcaaatgccccctgagtgactgcccccagcccaggccagaagac

SEQ ID NO: 12607 - DNA, 363 bp, Homo sapiens
  misc_feature 360: n = A,T,C or G
gaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaaccttaaatttgtaacatgagtcagtgggactggngtg

SEQ ID NO: 12608 - DNA, 258 bp, Homo sapiens
gtaacattctaatttaaagaggaacgaaaaggttcctagtttatgcagagactgaattttcagtatctccatattcttagttaatgcatcccagactctccgatgtttcttgctgtgatgggtgcataaaccttgacgtttgatgccattcagccttatctcaattctaggtttcttcctcagcttgctaactctgtcttgcaatctatctaggtccctagataaatgaaaattatagtagaaacaaatgaggaattg

SEQ ID NO: 12609 - DNA, 353 bp, Homo sapiens
  misc_feature 298: n = A,T,C or G
ttctgaagcagtgttttcatgttaaaagaaaatctgtgaagatagaaaacacatagaaaactaaggctaatagaacagtgatgccaaaacatgtatgagatcaccaccaactctaaaggagacggacactgcttaagaaaatatactttcacgaaataaagaatacattaaaaaatttttttctaaacgttccagttacttattgttgcaccataaactactctcaaacttagtggtttaaaataataaccattttctgatatttcactgttttgtgggtgagtcttctgtttcgtgntgtgctgacagcagtcaccctgtggtgcttggttgggggcgggctcagcaggaat

SEQ ID NO: 12610 - DNA, 354 bp, Homo sapiens
  misc_feature 2, 7, 45, 59, 112, 142, 196, 301: n = A,T,C or G
gngactntgagcctcactgctgctgagggtggggaaactgtaagngaacccctgtgggngcgggggagggtatccggtgcgcagggaggtggccagcgcccccgggcactgntgctcataggtacctttccgctgcctcctncctgctctcctgtgcaggaatgtctctgagctgttcacgttgatgcttcttggntggcaagacttgggtgtagacatgaaaccatcttactaaaagcgtcttaaaatgaccaattccagaatcaagcatattccgttttcttcctgcatgatccctggnccctcccgcaggctgagcaagtctgtaaactgattctgggagaaaccaagctg

SEQ ID NO: 12611 - DNA, 339 bp, Homo sapiens
ctgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggac

SEQ ID NO: 12612 - DNA, 400 bp, Homo sapiens
  misc_feature 2, 8, 92, 96: n = A,T,C or G
tnacaatncactgcgacactagtggatccaaagaattcgtacgagccaggatgctgtgatcgcctccttcgaccagctgtacgacgcctggngggncgggctggactggtgcaatgccggctggctcagtgatggctctgtgcaatatcccatcacaaagcccagagagccctgtggggggcagaacacagtgcccggagtcaggaactacggattttgggataaagataaaagcagatatgatgttttctgttttacatccaatttcaatggccgtttttactatctgatccaccccaccaaactgacctatgatgaagcggtgcaagcttgtctcaatgatggtgctcagattgcaaaagtgggccagatatttgctgcctggaaaattctcggatat

SEQ ID NO: 12613 - DNA, 302 bp, Homo sapiens
  misc_feature 13, 15, 34, 59, 88, 202, 222: n = A,T,C or G
ctgatggactggngncctatggagatattacagnggaactgaagaaggaggaggaatgngagagctacaccgtccgagacctcctggncaccaacaccagggagaataagagccggcagatccggcagttccacttccatggctggcctgaagtgggcatccccagtgacggaaagggcatgatcagcatcatcgccgccgngcagaagcagcagcagcagncagggaaccaccccatcaccgtgcactgcagcgccggggcaggaaggacggggaccttctgtgccctgagcaccggcctg

SEQ ID NO: 12614 - DNA, 361 bp, Homo sapiens
gctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggggttcta

SEQ ID NO: 12615 - DNA, 328 bp, Homo sapiens
aagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcgg

SEQ ID NO: 12616 - DNA, 342 bp, Homo sapiens
  misc_feature 15, 69, 118: n = A,T,C or G
gttctggattcccgncgtaacttaaagggaaactttcacaatgtccggagcccttgatgtcctgcaaangaaggaggaggatgtccttaagttccttgcagcaggaacccacttaggnggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctgg

SEQ ID NO: 12617 - DNA, 151 bp, Homo sapiens
  misc_feature 4, 10, 11, 19, 38, 47, 50, 53, 77, 79, 85, 91, 96, 118, 122,126: n = A,T,C or G
acanatgcgnnaacacagntccttgggccatgctgacntggacgccntgnagnaaaaccccaagcccttaattttcnanatgganatgctnaaggnggaaagccttggtccgtaccancagnaccnatgggccttgacagacgaaaagaag

SEQ ID NO: 12618 - DNA, 100 bp, Homo sapiens
  misc_feature 15, 57, 63, 79, 83: n = A,T,C or G
cttgaagggccccantaggggatccaaagaaattcggttcgagctcgggccgatttnggcacnggggaatccccaaaangaancattttttttcggcttt

SEQ ID NO: 12619 - DNA, 100 bp, Homo sapiens
  misc_feature 2, 4, 7: n = A,T,C or G
cnantanttccttccctgcctccaagctaagaattaaaacataatctcccttctttttctggcaaaactcccaacccctttctcccggatccacccaggc

SEQ ID NO: 12620 - DNA, 100 bp, Homo sapiens
accccagttgcagggcccaagcaggggggaggggacaccaggcttcccaggggacgtccctgagcagctccgaatgcttggttttcccggagcttcctgc

SEQ ID NO: 12621 - DNA, 100 bp, Homo sapiens
  misc_feature 2, 21, 27, 36, 44, 52: n = A,T,C or G
gngggaaatggtagattaaanatccgntaaaatcangacaattntaactggnctattctaacctatggggaacaattcggattttttaaaatgggaaaca

SEQ ID NO: 12622 - DNA, 100 bp, Homo sapiens
  misc_feature 3, 13, 28, 31, 41, 45, 53, 60, 71, 77, 81, 88, 91, 96: n = A,T,C or G
ganggttcaaaancagttccattctggngcnggctacaaangggnaaagaccnacttttnatacaacttcnatattngacnggggccnggnggctngagc

SEQ ID NO: 12623 - DNA, 112 bp, Homo sapiens
ataagcggggaagaccaattctaacagcaaataacagtcggagactcctcatacctcaggggttagaagcaggtctctctggagctacagaagaggggaagggatggtgggg

SEQ ID NO: 12624 - DNA, 103 bp, Homo sapiens
  misc_feature 14, 31, 36, 63, 73, 93, 98: n = A,T,C or G
gtggcccaaggggnactgaaggggccctccntaagnggaggggttggggagtaaggcctgggnaggaccctgntgactcggggggcgggagcnggganccagg

SEQ ID NO: 12625 - DNA, 106 bp, Homo sapiens
  misc_feature 4, 9, 31, 38, 50, 53, 69, 77, 81, 87, 91: n = A,T,C or G
gctngggcngccgggccctcgaaacgtcagngggtatnaggaaacacttnacnaaggggcaaaaggggnttcaattntaanaggggncagnggggatcttccaagt

SEQ ID NO: 12626 - DNA, 122 bp, Homo sapiens
  misc_feature 3, 18, 112: n = A,T,C or G
acngttcagcaggctgangaataaaatctaaaagttacctggttacagaaagaagatgccagatgacacttaaaacctactggggatatttaaaggaggcaataaaagaccnatggattggg

SEQ ID NO: 12627 - DNA, 100 bp, Homo sapiens
  misc_feature 16, 20, 25, 37, 43, 53: n = A,T,C or G
aactagaaataacttngcanggggngccaaagctaanaccccngaaaccagangagctacctaagaacagctaaaagagcacacccgtttatgtagcaaa

SEQ ID NO: 12628 - DNA, 100 bp, Homo sapiens
  misc_feature 2, 60: n = A,T,C or G
tntgcccaaaaagctcaaaaggctaaatgaatattatccctaatacctgccaccccactnttaatcagggggggaagaacggtctcaaaactgttggttt

SEQ ID NO: 12629 - DNA, 104 bp, Homo sapiens
  misc_feature 80: n = A,T,C or G
aaatctcctaatttcctaattggtggcttaataactctaatacccttccctgcatagggaactccttataagaatctggnctcccttttccctcggggcaccag

SEQ ID NO: 12630 - DNA, 100 bp, Homo sapiens
aacaggggaaagatcacgggaggcccaagggggggctggaccagatctagggtttcaagaaacccaagatcaatcccagccaagggcggagttccctgtg

SEQ ID NO: 12631 - DNA, 102 bp, Homo sapiens
  misc_feature 2, 11, 26, 41, 59, 65, 68, 73, 84, 86, 89: n = A,T,C or G
angcaggcctngccaaaactaccacnggcaataaagttttnggggccctgaagggagcngggganggnggctngtctatccctnanagnaccaaacgattcc

SEQ ID NO: 12632 - DNA, 100 bp, Homo sapiens
  misc_feature 45, 66: n = A,T,C or G
tctaattgggaaaggttttctgagtttaatatctaataaaataanatccctttacccaaaacaaangcttaactgtcttcggatgggcagaactcctgtg

SEQ ID NO: 12633 - DNA, 100 bp, Homo sapiens
  misc_feature 7, 15, 31, 36, 44, 46, 54, 63, 66, 78, 94: n = A,T,C or G
tgagacngacctgcnggacgaaaccatgaanagccngatccttntngccatccnggccgcctnagnggaagaaacttngggttatgaatcacangaaagc

SEQ ID NO: 12634 - DNA, 101 bp, Homo sapiens
  misc_feature 76: n = A,T,C or G
aaagaattattaaaaacatatggatccccatgaagccctactacaccaaagttaaccaggagattgggataggaanggggctgaggggcttaatcgttaat

SEQ ID NO: 12635 - DNA, 100 bp, Homo sapiens
  misc_feature 2, 6, 11, 19, 44, 47, 62, 68, 73, 86: n = A,T,C or G
cntttnggggncctacagncgtaaaagagataataagattagtnggncagttaaaagctttnattcgnccttngacaaaagtaaangggagggcattcca

SEQ ID NO: 12636 - DNA, 100 bp, Homo sapiens
  misc_feature 4, 8, 27, 42: n = A,T,C or G
atanaatnttagttcaactttaaattngcccacagaaccctntaaatcccctggtaaattaaacggttagtccaaagaggaacagctttttggacactag

SEQ ID NO: 12637 - DNA, 100 bp, Homo sapiens
gccagcctgattggactgggttatactcaaacccttcgaccaggagtcaaatggactttatcagctttaatcgaggggaaaaacttcagggcaggaggcc

SEQ ID NO: 12638 - DNA, 154 bp, Homo sapiens
  misc_feature 4, 5, 10, 13, 32, 34, 68, 75, 76, 83, 88, 94, 110, 116, 133: n = A,T,C or G
ccgnnagggnacntgcggggccaaaaccaagngnatccggggcagggggccttgaacttggaaaaagnagtttgnngccgatngcaantacatntttaaaaactggggtncttggnaggggggcaaagccccnaaagtccgccaaggacccttg

SEQ ID NO: 12639 - DNA, 155 bp, Homo sapiens
  misc_feature 6, 11, 27, 32, 41, 43, 49, 55, 69, 77, 118, 148, 151: n = A,T,C or G
gaattnaaaanggaaaattttcccctnggttngctagaatntngggggnattctntgtaagggtagctnaaataggncatcatgaaaggttaaaaaagcgagggggccatgttatgcngggggttaaggccagggcctttccaaccantgngcca

SEQ ID NO: 12640 - DNA, 100 bp, Homo sapiens
  misc_feature 3, 5, 19, 35, 45, 48, 53, 56, 60, 67, 72, 81, 85, 88: n = A,T,C or G
aantngggggcgtttttgnggatgcaaagaaattnacaggacccnttntaccntanaggnccaaggnaattnagggggggntgcnggnccccacgaaggg

SEQ ID NO: 12641 - DNA, 126 bp, Homo sapiens
  misc_feature 11, 19, 27, 117: n = A,T,C or G
aaggccaagtntgcccggntaaaggangctggttctgactttaccccactgcttccttctgctcaaggcctaaattttcccttctggtaaaagggaatctatatctataaaggtttnttcaattcc

SEQ ID NO: 12642 - DNA, 104 bp, Homo sapiens
  misc_feature 3, 14, 27, 34, 37, 41, 52, 54, 59, 64, 82, 84, 94: n = A,T,C or G
ctntatccatagangtgggcccaaacngaaagtngangagncactgggcctntnggggnagggngttatcagctacagggananagcagggttnggcctgcagc

SEQ ID NO: 12643 - DNA, 109 bp, Homo sapiens
  misc_feature 13, 18, 29, 33, 38, 45, 60, 64, 65, 71, 78, 89, 90, 93, 96: n = A,T,C or G
gatgtcacccccntcccntttgacagcantcgnagganggggggncgccggggccgccgnctgnnaacaanattcctnaaaatattttnngtnaanaaatggccttcat

SEQ ID NO: 12644 - DNA, 103 bp, Homo sapiens
  misc_feature 2, 8, 10, 12, 21, 25, 35, 53, 57, 62, 87, 97: n = A,T,C or G
tnagcttngntntgagggccnttcnaggcctcccnaatccaggccaaagcccnatgngcctngtccaggaactgcctgggccatgcnaggggccagnaaaggg

SEQ ID NO: 12645 - DNA, 190 bp, Homo sapiens
  misc_feature 21, 22, 34, 40, 45, 55, 57, 74, 89, 110, 118, 125, 128, 132,146, 152, 163, 167, 170, 173, 176: n = A,T,C or G
taggggatccaaaaattcgtnntttagaacaaangtttcntcctnaaagcaagcngntaacagctgacacagtnggggatggagctgtntgcaaaaatccttcgcatttnttttcctngtttcangtnccangtaaaatcagtttnaagttnaaaactaagtngctnaanaanganatgcccatttcccc

SEQ ID NO: 12646 - DNA, 100 bp, Homo sapiens
  misc_feature 12, 15, 31, 37, 45, 53, 59, 69, 88, 91, 93, 99: n = A,T,C or G
tactaacctttnagnctggtaaatccctaanaaaatngttggctnggaagatntaagtngaatgggaanctcattactatctatttcngancngctaana

SEQ ID NO: 12647 - DNA, 106 bp, Homo sapiens
  misc_feature 6, 9, 27, 37, 47, 48, 54, 57, 67, 70, 72, 84, 88: n = A,T,C or G
aaactnttntttccaaatcccaggccnggtttccagnaccatccagnngggccnaanaagccacccnggncngttctccaactntttnaaagggggcccaactttt

SEQ ID NO: 12648 - DNA, 386 bp, Homo sapiens
  misc_feature 10, 11: n = A,T,C or G
ttcggcacgnncgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggc

SEQ ID NO: 12649 - DNA, 400 bp, Homo sapiens
  misc_feature 5, 7, 50, 67, 201: n = A,T,C or G
cccgntnacttgtgcctgcaaaaccccctagtggatccaaaaaattcttnttagcgcgcggtgaggntggctaccccacgctcggagccatgccgtccaagggcccgctgcagtctgtgcaggtcttcggacgcaagaagacagcgacagctgtggcgcactgcaaacgcggcaatggtctcatcaaggtgaacgggcggnccttggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttc

SEQ ID NO: 12650 - DNA, 155 bp, Homo sapiens
  misc_feature 21: n = A,T,C or G
gcagttccagcagggcaagcntcttgcgtgcatcgcttcaaggccgggacagtgtggccgagcagatggctatgtgctagagggcaaagagttggagttctatcttaggaaaatcaaggcccgcaaaggcaaataaatccttgttttgtcttcac

SEQ ID NO: 12651 - DNA, 398 bp, Homo sapiens
  misc_feature 22, 43: n = A,T,C or G
cggtcgtaagggctgaggatcnttggtccgcacgctcctgctnctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagatt

SEQ ID NO: 12652 - DNA, 316 bp, Homo sapiens
  misc_feature 17, 230: n = A,T,C or G
gaacaactcccttcagnaaaccggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggnggtgttacatgtccatttcatgttttgggggcttttagccccacaaaacaccttcagtagagccttgattaaaaggaaacctgcag

SEQ ID NO: 12653 - DNA, 343 bp, Homo sapiens
  misc_feature 150, 151, 153: n = A,T,C or G
tctaggactctgcactgaatggctgacctgacctgatgtccattcatcccaccctctcacagtttggacttttctcccctctctttctaagagacctgaactgggcagactgcaaaataaaatctcggtgttctatttatttattgtctnncngtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatatt

SEQ ID NO: 12654 - DNA, 400 bp, Homo sapiens
  misc_feature 29, 31, 69: n = A,T,C or G
cttctttgggaaaaaacccctggtttttngngcgcctgcaggtccacactagtggatccaaagaattcnttacgagctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggagg

SEQ ID NO: 12655 - DNA, 395 bp, Homo sapiens
  misc_feature 3, 8, 55, 60, 87, 389: n = A,T,C or G
aanaaacncctgtcttttggggcgcctgaaggacccacactagtggatccaaagnaattntttacgagagatgggtcaccagcagcngtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccaaaaaaaaaaagagtacttctagagcggccgggggcccatcgattttccacccgggnggggta

SEQ ID NO: 12656 - DNA, 397 bp, Homo sapiens
  misc_feature 4, 23, 31, 56, 214, 322, 352, 354: n = A,T,C or G
tgcnacactagtggatccaaagnaattcgtnacgaggaaataagtaaatgccattnaaaggattacattggtttagaactttaccttttgcagcaatgttattccatcgtaatttgtgcaaacctgtgaaataagtagtgacagtgagactgaactgtagacaaacttctcagttttcctcactggaaattatattttaaaaattgagtatttntaatctgttcatataatgtgttactcctctgtagtcatgaaaatctcacaggcaacatacatttaatctgtcttccttatattagttttttttttttaatgaaaaatnctgttgggaaaggaaattgggactaggttntntagaggcaaaccaaagaggcaagaaataagaaaattgataatt

SEQ ID NO: 12657 - DNA, 328 bp, Homo sapiens
cctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgaga

SEQ ID NO: 12658 - DNA, 327 bp, Homo sapiens
actttttgaaatgccagtctgaaaataattaagatatctctgctttgtatgagtttcttttatgaaacttgataccacgggagtccagtaatattggccacaaaagccagagaaagtaccaagcccagctttgttatcatagccacttcctgccctgcttctgttatttttagtgttttttcagatataaatcggggtccaggaaatcctcaccagaatctggcactgcagccaaaggcgatacttccagagttctagtaggctgctatggaatttctggcatgaaaattcttgacccctcacactttaccccctgtacagcacagg

SEQ ID NO: 12659 - DNA, 317 bp, Homo sapiens
ttcggcacgagacaagatggtctcttctcagaaaacaaagaaaaactgatcaataatgccataacagcattactgtcccaagaaggggatgtcgttgcttcaaatgcggaacttgagagtcagttccaggctgtgaggaggcttgtggcatccaaagctggtttcctggctttcactcagcttccaaagtttcgcgagcgtctaggggtgaaggtagtaaaagcactcaaaagaagcaacaacggaataatccatgcagcagttgatatgctttgtgcccttatgtgtcccatgcatgatgactatgacttaagaca

SEQ ID NO: 12660 - DNA, 211 bp, Homo sapiens
ggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 12661 - DNA, 342 bp, Homo sapiens
acaaaacagttcttgggattgaatgactcacatttaccttgtggtaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtca

SEQ ID NO: 12662 - DNA, 343 bp, Homo sapiens
  misc_feature 1: n = A,T,C or G
natccatacgccctccaagaataccctgcagcttctgctggcacttcttgagaagtgctatggctagtgaaatgccccacaggacccactagcgtttccagatacccactggtgaagcacccccaagggactctcaggctctgggaaacaatcatcttcaaccctctagaatgtccacggactttactagcaccttctaaaagtgccctgtgggctcttctgtcttttcatttttccagaatcgcactgtgcttaatcaactaccctgctcactgcattaatttgtcaggagctcagctgagctgaagagagctgagctgccaggtgtttgagtagcctgatt

SEQ ID NO: 12663 - DNA, 323 bp, Homo sapiens
agaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattat

SEQ ID NO: 12664 - DNA, 322 bp, Homo sapiens
gcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatc

SEQ ID NO: 12665 - DNA, 105 bp, Homo sapiens
aggaggctgaggtgagagaatctcttgaaccccggaggcagcggttgcagtgagctgagatcgcgccattgcactctagcctgggtgacaagagtgaaactccat

SEQ ID NO: 12666 - DNA, 324 bp, Homo sapiens
  misc_feature 4, 15, 20, 26, 39, 97: n = A,T,C or G
gctncaatgacgagnagatncgggcngagggcaatagcnggttcactgtacactgccctgaaggatggctgcacgaaacataccggtaagtggggcnagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctga

SEQ ID NO: 12667 - DNA, 306 bp, Homo sapiens
  misc_feature 170, 173: n = A,T,C or G
tcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagnggntcttccagggggaattctcagctcttgggaacccccttgctcccaggggaggggaaacctttttcattcaacattgtagggggcaagctttggtgcgccccctgctgaggagcagccccaggaggggaccaga

SEQ ID NO: 12668 - DNA, 325 bp, Homo sapiens
aacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatgg

SEQ ID NO: 12669 - DNA, 262 bp, Homo sapiens
  misc_feature 261, 262: n = A,T,C or G
ctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatann

SEQ ID NO: 12670 - DNA, 327 bp, Homo sapiens
agatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggcccgctctggaaccgtctcaaggtgtttgacggcat

SEQ ID NO: 12671 - DNA, 328 bp, Homo sapiens
gaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaag

SEQ ID NO: 12672 - DNA, 316 bp, Homo sapiens
  misc_feature 142: n = A,T,C or G
ttcggcacgaggcgatgtggtctggacaacacaaagcaagatgaccgacctcctttgacctctttgctctccaaaccagcagttcctactgtcgcctcttccacagacatgctccacagcaaactctctcagctccgggagncacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtt

SEQ ID NO: 12673 - DNA, 328 bp, Homo sapiens
caaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaa

SEQ ID NO: 12674 - DNA, 282 bp, Homo sapiens
  misc_feature 9, 13, 44, 109, 258, 272: n = A,T,C or G
gcagacagnaggnttgatttgatcaatcctatttgaaatttggnccttctcctgtccaccaagaatgtaagttgtgtatcatctttcctggaaggctttcaaaagtggngagacctctagtttcctgggttatgcttgagagggggattaagcatctggacttctgagagacctgcctgtgtgaggagcctgaagggagactgcaagaccatcacccttcccatccgcctagagcctttgctaaactggagaaggggngtaatattctgagnttaagaaagc

SEQ ID NO: 12675 - DNA, 219 bp, Homo sapiens
catattttgaaatacttttctcccaaactgggtttattagcgtgtaccctgcttttccactttaaaaatttatgccatatgtccagcttccagtcagtgcttctggttagcatgagataactagatttactgtagatggtagataaaagtccagtgaaaagcaaagatgtgtaatgttttggtagcctcagtgctcttatcccaagtaaaagcaaagtt

SEQ ID NO: 12676 - DNA, 336 bp, Homo sapiens
gccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtccctccaagccccttggagg

SEQ ID NO: 12677 - DNA, 324 bp, Homo sapiens
ctgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaag

SEQ ID NO: 12678 - DNA, 323 bp, Homo sapiens
ggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtgggaagcccctgtgaaggacaacacccctgctt

SEQ ID NO: 12679 - DNA, 352 bp, Homo sapiens
  misc_feature 1, 171, 172, 173, 273: n = A,T,C or G
ntcgattccattccattccattaatttccattccattcgacacctttccattgcagtcttttgccttcgagtccattccgttcgattcccttccattcgattccattccattggagtccgtaccagtcgagtccattctattccagtccattagtttcgactccattgcgnnngagtgcattccattccgtggctgtccattccattccgtttgatgccattccatacgattccattcaattcgagaccattctattcctgtccattccttgnggttcgattccatttcactctagtccattccattccattcaattccattcgactctattccgttccattcaattccatt

SEQ ID NO: 12680 - DNA, 325 bp, Homo sapiens
attcaaatgatcatccaaatgaatgtgaagtcacaaaggagcagtgaggatgctgtaaggtcccatatcaggggcagtgatctagccagaggggttagggaagcttgcctgagggtttagatgattcctgtgggagcatctgcattcatagcagtttgctgtggtctgggaagactgtcctttgtgctctcttgtggttgcacctcacacatcctgcctgggacaccatatatctaagaaatcgttatataagaacaagagaggctgggcatgatggctcacgcctgtaatctcagcactttgggagtcccaggtgggacgatca

SEQ ID NO: 12681 - DNA, 328 bp, Homo sapiens
  misc_feature 1: n = A,T,C or G
natttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtat

SEQ ID NO: 12682 - DNA, 239 bp, Homo sapiens
  misc_feature 143: n = A,T,C or G
ttcggcacgaggagctgccttattctttttgaaggctgtgtgatattaggaagggtattaaaaacagttgttatcgttttaacttagaaggtatatttaaatactaaaagttagaaagaatgcgatttcaagcgggacgtggnggttcatgcctgtaatctcagcactttgggaggctgacgcaggaggatacttgagcccaggtgttcaagaccagcctgggcaacatagtgagactc

SEQ ID NO: 12683 - DNA, 326 bp, Homo sapiens
cgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaagggttttttttgtacg

SEQ ID NO: 12684 - DNA, 325 bp, Homo sapiens
catcgatgtgctgtctctggagtgataagaaagggctacatctccctaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagtta

SEQ ID NO: 12685 - DNA, 231 bp, Homo sapiens
agactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatac

SEQ ID NO: 12686 - DNA, 310 bp, Homo sapiens
tatctgcctttccacctagaacatgcactacatgacgggaaaaacattttttaaaagactgtgggccgggcgcagtggctcatgcctgtattcctaacactttgggaggccgaggcaggtggatcacctgatgtcaggagttcgagaccagcctaatcaacatggtgaaaccccgtctctacaaaaaatacaaaaattagccaggtgtggtggcatgcgcctgtaatcccggctactcgggaggctgagcaggagaattgcttgaacacgggaagtggagattgcagtgagctgagatcgcaccactaca

SEQ ID NO: 12687 - DNA, 327 bp, Homo sapiens
gacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaatcttgtgctagaatactttttaaaaggtattttgaataccattaaaactgcttt

SEQ ID NO: 12688 - DNA, 327 bp, Homo sapiens
  misc_feature 107, 110, 130, 203, 205, 208, 241, 258, 291: n = A,T,C or G
atggctcttctattttccaatcacacagcttggcatgtaggaaaggttgaatgatcctctaagactgtgttggtcttcgtattctgtaaaacccattttttttttgnggncttacagatgtttagaaagnggcacaggttacttgaattgtctacctgccagcattctgatatagcacaaaaagctattttcctttatttttngnatnattttttatttttctggcattgagctctagggnggatgagggtttatggncctctgatcataagctccattctaaaaactggncactgttagctgaaattgctttggttccccaaatgc

SEQ ID NO: 12689 - DNA, 328 bp, Homo sapiens
cagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacgtctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgc

SEQ ID NO: 12690 - DNA, 232 bp, Homo sapiens
gtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgttt

SEQ ID NO: 12691 - DNA, 324 bp, Homo sapiens
cgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacaggataagaccacagtccttagcccaatcccagctatacagtca

SEQ ID NO: 12692 - DNA, 304 bp, Homo sapiens
  misc_feature 275, 282: n = A,T,C or G
ctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggcccctgccagctatggcagaaaatggccgagacggtgagcgaaggccccccagggggnggcaggnaattccttggagtgccttggac

SEQ ID NO: 12693 - DNA, 328 bp, Homo sapiens
atcatgccatgtagctggtgggtggcccgtatcttgggcatggtgtgaaatcacttcatatatcatgtgctgtaaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgta

SEQ ID NO: 12694 - DNA, 321 bp, Homo sapiens
cagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagt

SEQ ID NO: 12695 - DNA, 327 bp, Homo sapiens
ctgtcatatatgttaaaaatcattaaaagttcattttttctcccattatgggaaggatacatgctcctactagtaaatttagttggtagaaaaaaattatcactatctagactgctttccctttagtctttatgcatagctttctgtctgcctatttttactttgtgtttgtaacttactattataaaatatgcatctctatgttcgttgtcaacattatttacaataacatggagtggatttacatgtattctctatatttggattaaaggagatagagtatgtgaaattaaatgggagaagtatctgatacataacaggcaatac

SEQ ID NO: 12696 - DNA, 133 bp, Homo sapiens
agaatttcaaagccttcgctagtctccgtatggcccgtgccaacgcccggctcttcggcatacgggcaaaaagagccaaggaagccgcagaacaggatgttgaaaagaaaaaataaagccctcctggggactt

SEQ ID NO: 12697 - DNA, 330 bp, Homo sapiens
ctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtag

SEQ ID NO: 12698 - DNA, 320 bp, Homo sapiens
ccctgaacttaaaataaaagttgaaaaaaagaagacaaagaaatagaaaagtatcttctattattattccctaaaacaacaaaactctaccttctaacatgtattatttcaacattatttcacatgaaataactcccagatataaaaataaagttagaaattgaaaatccacactggaagttttaatcgtctaaatccagggatccagagttactggaaaatcatcccatgacagcctatgaaatatactaatcacaggccgctgactcagtggacattcaataaataagaactgatgaagatgaaaatatgttgctgca

SEQ ID NO: 12699 - DNA, 325 bp, Homo sapiens
aaaacatttatgttagtattaaataatagatttagtcacagtgtgcatacctatagccactatgtacaaaggatgtgatgggggacgggaagaaccatgaggaaggcacagggggaaaaaagtgaaaattatgggaggctccattccctgcttcagagagtttgcaatctcgtaacctgttacttggaaatacagtgtcctggagccagttcatgctagctcaccagagcctatggttacattttcaggaattttgccagtcagtagtttaacaccaccattattaaaaattagattatgtaaatttacagtccaataaagtata

SEQ ID NO: 12700 - DNA, 327 bp, Homo sapiens
gccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtc

SEQ ID NO: 12701 - DNA, 262 bp, Homo sapiens
  misc_feature 148, 194, 211, 228, 241: n = A,T,C or G
gcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcagganctgctgcagaggatgacggacaagtgtttccggaagtgtatagggnaaacctggggggctccntggacaactccgagcanaagtgcatcgccntgtgcatggacccgctacatg

SEQ ID NO: 12702 - DNA, 324 bp, Homo sapiens
ggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggc

SEQ ID NO: 12703 - DNA, 325 bp, Homo sapiens
gaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggactcggaggcctgggccgtggccagataggaagtttgcatcatccacgtggctccgttgc

SEQ ID NO: 12704 - DNA, 329 bp, Homo sapiens
gttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatcca

SEQ ID NO: 12705 - DNA, 111 bp, Homo sapiens
ctcactttccctgatcctgcaattaaagggttaatgtgtggcatatggaagggactcccaggaccctgtgcccagcttccatgctgactgatggttaaataatgtgattgt

SEQ ID NO: 12706 - DNA, 332 bp, Homo sapiens
gaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggat

SEQ ID NO: 12707 - DNA, 321 bp, Homo sapiens
cctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggt

SEQ ID NO: 12708 - DNA, 324 bp, Homo sapiens
gttttacaaagggccattctgtgtcacctagcaaatgatctctttcatcctgccctcttgctacttcctaatcacgattcattccatttttccatctttttcatttgatatcaatctattagtgaatgctttgcgaactataaaaatgaatcagaagtggatcctgcttttatggcgtttacaaccaagtaaaggagattgagtcatggaatgtagagttaaaaggaattgcaaagatcttctggtccagctgtctatctaatgcttaaatccgttttcaaacagctccgttgagttctgtccacctgtgcttgatggcttcca

SEQ ID NO: 12709 - DNA, 209 bp, Homo sapiens
  misc_feature 159, 180, 199: n = A,T,C or G
ccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggnagacaagagagtagccctctncagtttcagcaaccgctanggttcctatt

SEQ ID NO: 12710 - DNA, 327 bp, Homo sapiens
actgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgat

SEQ ID NO: 12711 - DNA, 330 bp, Homo sapiens
cctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggcccctctggacaagtggcgggccctgcac

SEQ ID NO: 12712 - DNA, 327 bp, Homo sapiens
gtttgttgacactaatacagatgattaaggaaaacagctgatctttggggaagggagctaccaacactttatacacacacacacgtgcacacacacacacacactatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggata

SEQ ID NO: 12713 - DNA, 326 bp, Homo sapiens
gcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctg

SEQ ID NO: 12714 - DNA, 322 bp, Homo sapiens
ttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcg

SEQ ID NO: 12715 - DNA, 107 bp, Homo sapiens
tttttatatagttgtaaaattccattatattccattgccaaagaaacattaagaactttgtatagctgtataaaaagcaactaattttttaaagaataaacatttta

SEQ ID NO: 12716 - DNA, 355 bp, Homo sapiens
gcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcg

SEQ ID NO: 12717 - DNA, 313 bp, Homo sapiens
gtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttt

SEQ ID NO: 12718 - DNA, 325 bp, Homo sapiens
aaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttga

SEQ ID NO: 12719 - DNA, 310 bp, Homo sapiens
ttcggcacgagacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttt

SEQ ID NO: 12720 - DNA, 319 bp, Homo sapiens
ggtgattttaataataattaattgtatatgttttactgtactagacttagtaaaacataagaaagacgtataacatagttgaacaactttaagttgctctaagaagtttcctatgtgaggctgggtgccatggctcacgcttataatcccagcactttgggagaccgagatgggcgtatcacttgagatcaggagttcaagaccagcctggccaaccaaccccatctctactaaaatacaaacattagccgggcatggtggcacatgcctgtaatcccagctactcaggaggctgaggaaggagaattgcttgaacaca

SEQ ID NO: 12721 - DNA, 344 bp, Homo sapiens
gcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttc

SEQ ID NO: 12722 - DNA, 326 bp, Homo sapiens
aatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaag

SEQ ID NO: 12723 - DNA, 267 bp, Homo sapiens
  misc_feature 195: n = A,T,C or G
caggctggagtgcaatgacgtgatcttggctcactgcaacctccgcctcccaggttcaagtgattcccctgcctcagcctcccgagtagctgggattacaggcgcctgccaccacccccgcctaattttttgtatttttagtagagacggggtttcaccgtattagccaggatgatctcaatctcctgacctcgngatccatccgcctcgccctcccagagtgctgggattacaggcgtcagccaccgtgaccggctcagactgtac

SEQ ID NO: 12724 - DNA, 277 bp, Homo sapiens
  misc_feature 276: n = A,T,C or G
acgtttgtcctggaaagatgacacttgagccactgggagtggggacgtttgtcactgtagccctcggtgcttccagtgcctggttggtggggagaagctgggtacggcctctgccagctctgctttgtgggccccaccccagtgtggcccaggggctgcaggttctgggtcagtggcacctcgagagtacttctagagcggccgcgggcccatcgattttccacccgggtggggtaccaggtaagtgtacccaattcgccctatagtgagtcgatna

SEQ ID NO: 12725 - DNA, 326 bp, Homo sapiens
cagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaactt

SEQ ID NO: 12726 - DNA, 115 bp, Homo sapiens
ctagtctcgagagtacttctagagcggccgcgggcccatcgattttccacccgggtggggtaccaaggtaagtgtacccaattcgccctatagtgagtcgatacattttcactgg

SEQ ID NO: 12727 - DNA, 353 bp, Homo sapiens
tggtaagggatgatattgtggggatgttagaagaaacatttgtcgtatagaatgattggtgatggcctggatacggttttgaatgaaccgagaaactaaacggaagatacaaggtccgaataaaaggagaaaaatgggtattaaaggactaagaattgggaggacccgggacatctgattagagagtgcctaaggagattcagcatagtcctgccagcaaagattatttatatacttcaagagttaagagtggcagtttggggatagcaccaggagatatcagctgtcatggcttggagaaacagtgtaaaccggcagtgtaaacaagagcagggcatgtatgaatagttgag

SEQ ID NO: 12728 - DNA, 325 bp, Homo sapiens
tagaaactgagtcgaattctgggccctgccagaagcgtggaccagttatgacactgcaggaaagaattatgtatttggttttggagtcagataggcatgagtttaagtcttatttctgctgcttatttgtagcatgctctttgggagttatctcagatttttcatttataaaatgtgtgggttttcaattttaagacttagtgtaaagctagtcgttaagacagcgtggtatcgacaaaacattgaccatgtagatcagtgcaacacatatcaatggtgaaaagattgtcttttcaacaaatggggctggaactatggggcttac

SEQ ID NO: 12729 - DNA, 215 bp, Homo sapiens
agcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttc

SEQ ID NO: 12730 - DNA, 134 bp, Homo sapiens
tgggggggtggggtggacttttagagtagaagctgcacttggcaataagctcgtgtcgtctgtcagagcccctctctcaactctgtgacctgataatgtttctaagaaaaagaaaaaaaggacaaaagggaggg

SEQ ID NO: 12731 - DNA, 326 bp, Homo sapiens
gaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttatt

SEQ ID NO: 12732 - DNA, 209 bp, Homo sapiens
gctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataact

SEQ ID NO: 12733 - DNA, 327 bp, Homo sapiens
cgcgcgcctgcaggtcgacactagtggatccaaagaattcggtacgagcccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccagga

SEQ ID NO: 12734 - DNA, 300 bp, Homo sapiens
agccttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactg

SEQ ID NO: 12735 - DNA, 364 bp, Homo sapiens
  misc_feature 45: n = A,T,C or G
cgcgcgcctgcaggcccgacactagtggatccaaagaaattcttnacgagagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctg

SEQ ID NO: 12736 - DNA, 352 bp, Homo sapiens
atcaggatagagccaagtgatgcttctgagttaggatccaatagaaggtacaatgtactgaatgtgtgtgtccctccaatattcatatattgaaatccaaatccccaatatcatggtattaggatgtggggcatttgggagtagattagttcatgagggtggagccctcatgaacgagattagtgactttgtaaaaaagaacccagagagctctcccaccctccttctgccacatgaggatacagcaagaagtcagcatctgaagcaagccctcaccagacaatgaatcttctgacgccttgatcttggacttcccagcctccagaactgtgagaaataaatgtttgttgtt

SEQ ID NO: 12737 - DNA, 341 bp, Homo sapiens
  misc_feature 335: n = A,T,C or G
aagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaaagttgtggaagaggcagaaaatggaagagacgcccctgctaacgggaatgctaatgaggaaaatggggagcaggaggctgacaatgaggtagacgaagaagaggaanaaggtg

SEQ ID NO: 12738 - DNA, 338 bp, Homo sapiens
ttcggcacgaggacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataat

SEQ ID NO: 12739 - DNA, 127 bp, Homo sapiens
ctgctgatggccagactctgtttgctggctacacggacaacctggtgcgagtgtggcaggtgaccattggcacacgctagaagtttatggcagagctttacaaataaaaaaaaaactggcttttctg

SEQ ID NO: 12740 - DNA, 358 bp, Homo sapiens
  misc_feature 148, 302, 315: n = A,T,C or G
gttagcatctctgctggtaaactttagaggctgatatcatcttcactttggccctggtgggtataaagttctgagcctgattttgccagattttgtccaaggaatagaatatgccccaacccatgaagcacagaactagtggcctgcngccaccttccacagcccaggccataggaggcccctggatatgcgaggggaaagaattcacagtgtgcacagaacgtgccaggcccacggtgcactctcatggccactctttgagatatgcgtgaccaagtcagggatgaggagacagagctcgnaaagatgaagtgntacgcaacaaaatgtgattgactcgcctcacaggctgtggcta

SEQ ID NO: 12741 - DNA, 316 bp, Homo sapiens
gtttaaaatttatttaaaatcatgattattgccttgcctttattaatactgtattttattttttcctaaaagaataaagttgtgtattcaccttgagttaccaaactttaggtgctttaattttgtttggtttgatgttaaatagtggttgcttctaatatttttatgttcatttttgggaatgataaactgttttccaagtatatgccaatatggaaaatttgctttatcgtatatttgataattgtgtttacatgttgaatgcactattcttgaatgtttatgaattatattttcatcaataaacagaacacat

SEQ ID NO: 12742 - DNA, 398 bp, Homo sapiens
  misc_feature 3, 11, 36, 41, 44, 142: n = A,T,C or G
ggngcgcctgnaggccgacactagtggatccaaagnaattnttncgagaggaaatggaaaccgtctgaactatcctgcccgccatcatcctagtcctcatcgccctcccatccctacgcatcctttacataacagacgaggncaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaatt

SEQ ID NO: 12743 - DNA, 208 bp, Homo sapiens
  misc_feature 27, 149, 176: n = A,T,C or G
ccaaagggcctaagggaggacaacggngttgttggtcccacaggccccgttggagctgctggcccagctggtccaaatggtccccccggtcctgctggaagtcgtggtgatggaggcccccctggtatgactggtttccctggtgctgntggacggactggtcccccaggaccctntggtatttctggccctcctggtccccctggtc

SEQ ID NO: 12744 - DNA, 332 bp, Homo sapiens
  misc_feature 32: n = A,T,C or G
tgccaccgttatctcccacaaccctgagaccnagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactg

SEQ ID NO: 12745 - DNA, 400 bp, Homo sapiens
  misc_feature 17, 42: n = A,T,C or G
cgcgcgcctgcaggtcnacactagtggatccaaagaattcgntacgagtttctttccaaaatttacttatcctgtcccctctcaggttatatgaaactttcctggtgtttagaacctcaaacggaactaatttctcttcctaatttcaggtcagattttggggaatgtgctcagttatcatgctccaagatagagattccctttcattgtttttttcctactacattctatccttccccaaagaggtcgtattgaagtgatttgcaaatcttaggtcctctgcccccatagtccttgaaccctgaaaatgctaaagtaaagctggaattttaattatttttgtgtattaatgctacatgctacattcaataaaaatcaggagtaaatttttactgaatca

SEQ ID NO: 12746 - DNA, 366 bp, Homo sapiens
  misc_feature 42, 43: n = A,T,C or G
cgcgcgcctgcaggtcgacactagtggatccaaagaattctnnacgagggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtg

SEQ ID NO: 12747 - DNA, 397 bp, Homo sapiens
  misc_feature 41: n = A,T,C or G
cgcgcgcctgcaggcccgacactagtggatccaaagaattntgcacgagaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcc

SEQ ID NO: 12748 - DNA, 151 bp, Homo sapiens
caacaatgtgtaagatgaattgggtggatggagattggaatcagagaggctaaaaaggaggctattatcatccatctcagagagacaaggacttatcaaaagaggatagaagttggactgaagatttagagatgggtaccagggacatttc

SEQ ID NO: 12749 - DNA, 399 bp, Homo sapiens
  misc_feature 35, 43: n = A,T,C or G
gcgcgcctgcaggtcgacactagtggatccaaagnaattcgtnacgagggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaag

SEQ ID NO: 12750 - DNA, 398 bp, Homo sapiens
  misc_feature 1, 9, 39, 41, 42: n = A,T,C or G
ngcgcctgnaggccgacactagtggatccaaagaaattntnnacgagataaaggtttagtaaaaagatttaaaattctacacaatcattctatataggttcttagccttatgtttctttatagtatatgtgaaaccttattatttatttgtatgttaattgctttcttctgtaaaatataagttctaaagagaagaaccttatcttgttaactgctgtaaacatagagcttagaatcatgctcagcttatggtaaagtaagcatttttcattgacttatcgagtagtgagtgggtaatgaactgatttaatagtgggtaattaagaaaattagaaaagacttcaaaatctttacttaaccaaacgcttaacactatcaagctgtctaaagagtgttgc

SEQ ID NO: 12751 - DNA, 110 bp, Homo sapiens
tcgagagtacttctagagcggccgcgggcccatcgattttccacccgggtggggtaccagggtaagtgtacccaattcgccctatagtgagtcgtattacaatttcactg

SEQ ID NO: 12752 - DNA, 308 bp, Homo sapiens
  misc_feature 304: n = A,T,C or G
cattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaanatgc

SEQ ID NO: 12753 - DNA, 313 bp, Homo sapiens
  misc_feature 124, 126, 257: n = A,T,C or G
cgtgaacgtggtatcaccattgatatctccttgtggaaatttgagaccagcaagtactatgtgactatcattgatgccccaggacacagagactttatcaaaaacatgattacagggacatctnangctgactgtgctgtcctgattggtgctgctggtgttggtgaatttgaagctggtatctccaagaatgggcagacccgagagcatgcccttctggcttacacactgggtgtgaaacaactaattgtcggtgntaacaaaatggattccactgagccaccctacagccagaagagatatgaggaaattg

SEQ ID NO: 12754 - DNA, 274 bp, Homo sapiens
  misc_feature 21: n = A,T,C or G
aaaagtatccaaggttagggntggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactg

SEQ ID NO: 12755 - DNA, 396 bp, Homo sapiens
  misc_feature 19: n = A,T,C or G
ggagtccccgccccctccnctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgcca

SEQ ID NO: 12756 - DNA, 176 bp, Homo sapiens
aggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgtt

SEQ ID NO: 12757 - DNA, 275 bp, Homo sapiens
ggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttattc

SEQ ID NO: 12758 - DNA, 350 bp, Homo sapiens
cctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgtt

SEQ ID NO: 12759 - DNA, 341 bp, Homo sapiens
ttcggcacgagcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatc

SEQ ID NO: 12760 - DNA, 391 bp, Homo sapiens
  misc_feature 2, 4, 31: n = A,T,C or G
gncnacactagtggatccaaagaattcgttncgaggcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagag

SEQ ID NO: 12761 - DNA, 399 bp, Homo sapiens
  misc_feature 16, 40, 41, 43: n = A,T,C or G
gcgcgcctgcaggtcnacactagtggatccaaagaattcnntncgaggtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgg

SEQ ID NO: 12762 - DNA, 400 bp, Homo sapiens
  misc_feature 12, 16, 40, 41, 43, 337: n = A,T,C or G
gcgcgcctgcangtcnacactagtggatccaaagaattcnntncgagctggggcagcagcaaccagagcctcttcctgtgtcctgtgtgtctggtatgtttacaccttgctctgagtttttctcttgttttctttttttaattaagtttacattttagtttctttgacatcttgtttacagtttttgtctgatgttttttcttttgtagtgtcttatgccctagatttagtcatcttgttaaatatatttggatatgaaatcttgacgaaaagaaaataactcctgaaaaagagggtctatcttgccacacgttaaaaacaaaaataatgtccttgnggcctcttacttgataaagttgcaccaggacggtctgagaaaggcaggcggtgtaatatgtgg

SEQ ID NO: 12763 - DNA, 370 bp, Homo sapiens
  misc_feature 42, 44, 143: n = A,T,C or G
tgcgcgcctgcaggtccacactagtggatccaaagaattcgntncgagctacacagtacccctcccctcgtgtctgctcaggcagctcgaggcccccgaccaacacttgcaggggtccctgctagttagcgccccaccgccgnggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgag

SEQ ID NO: 12764 - DNA, 187 bp, Homo sapiens
  misc_feature 17, 41, 43: n = A,T,C or G
cgcgcgcctgcaggtcnacactagtggatccaaagaattcntnacgagtgcctttgtgggggcagaatcacatggcaaaagctttgaaaatcataaagatataagttggtgtggctaagatggaaacagggctgattcttgattcccaattctcaactctccttttcctatttgaatttctttggtg

SEQ ID NO: 12765 - DNA, 396 bp, Homo sapiens
  misc_feature 20: n = A,T,C or G
gcagaggcagcatccagcgncggcgccagcagttccagtccgttgctttactttttgcttcaccgacatagtccttatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatgaattgtcatgaaaaattgggg

SEQ ID NO: 12766 - DNA, 393 bp, Homo sapiens
  misc_feature 17, 59: n = A,T,C or G
tgactgacgtgggtganatcaagggccacaggcggacctacgtgggcgccatgcccggnaagatcatccagtgtttgaagaagaccaagacggagaaccccctgatcctcatcgacgaggtggacaagatcggccgaggctaccagggggacccgtcgtcggcactggtggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtg

SEQ ID NO: 12767 - DNA, 400 bp, Homo sapiens
  misc_feature 8, 17, 40, 46: n = A,T,C or G
tgtgtgancactgcagncccgacactagtggatccaaagnaatttngcacgaggccatgattgtgaggcctccccagccatgtgaactgtgagtccattaaacctcattcctttataaattacccagtcttgggtatgtctttattagcaacatgaaaacagaccaatacaggcagccccctctcctcttctgtatctgatcaaagactgagctaactttagttgttttgcaattgagcgaaaatgactttcccagccttggctgtaagaagcccattcctgggaactggagaggagcaggctggtgaatgagggagcagggagagtcgcccagtgttttcagtccccagagtgcctggaacctcagcgtagacttgtctgtttactcagtcccaggatc

SEQ ID NO: 12768 - DNA, 400 bp, Homo sapiens
  misc_feature 10, 14, 38, 41, 64: n = A,T,C or G
gcgcctgcangtcnacactagtggatccaaagaattcnttncgagcggggagtggggggggagnctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcacta

SEQ ID NO: 12769 - DNA, 400 bp, Homo sapiens
  misc_feature 24, 49: n = A,T,C or G
gacactagtggatccaaagaattnttacgagcaggtgctgcttgtcctncttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatg

SEQ ID NO: 12770 - DNA, 398 bp, Homo sapiens
  misc_feature 2, 16, 40, 43: n = A,T,C or G
gngcgcctgcaggtcnacactagtggatccaaagaattcnttncgagaggtcgcggcgacatggcccaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 12771 - DNA, 115 bp, Homo sapiens
ttcggcacgagcataatctttgttcccgttcctcaactgaaatctttccagaaaatccaagtccggctagtacgcgaattggagaaaaagttcagtgggaagcatgtcgtcttta

SEQ ID NO: 12772 - DNA, 397 bp, Homo sapiens
  misc_feature 14, 39: n = A,T,C or G
gcgcgcctgcaggncgacactagtggatccaaagaattntttacgagccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcc

SEQ ID NO: 12773 - DNA, 114 bp, Homo sapiens
ttcggcacgaggagtacttctagagcggccgcgggcccatcgattttccacccgggtggggtaccaggtaagtgtacccaattcgccctatagtgagtcgtattacattcactg

SEQ ID NO: 12774 - DNA, 119 bp, Homo sapiens
  misc_feature 2, 12, 47, 63, 106: n = A,T,C or G
gnactggcttgnagaagaaagccacaactaagcttctgtgtgatgcnggcggcagcacttaantgccagaagccgggggatgggggttacaagtatcagagagacnggcaaggggcttg

SEQ ID NO: 12775 - DNA, 245 bp, Homo sapiens
  misc_feature 18, 208, 211: n = A,T,C or G
cctcagagtacttcgagnctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgnggnttgactatttctgtatgtctccatctattgatga

SEQ ID NO: 12776 - DNA, 397 bp, Homo sapiens
  misc_feature 36, 42, 44: n = A,T,C or G
cgcgcgcctgcaggtcgacactagtggatccaaagnaattcntnacgagggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgat

SEQ ID NO: 12777 - DNA, 290 bp, Homo sapiens
tccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaat

SEQ ID NO: 12778 - DNA, 338 bp, Homo sapiens
  misc_feature 1: n = A,T,C or G
ntgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacatt

SEQ ID NO: 12779 - DNA, 316 bp, Homo sapiens
  misc_feature 14, 42: n = A,T,C or G
gcgcgcctgcaggncgacactagtggatccaaagaattcttnacgagtctggacccggggcctccccttgagtagagacccgccctctgactgatggacgccgctgacctggggtcatgacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtctt

SEQ ID NO: 12780 - DNA, 328 bp, Homo sapiens
ctcacttttcgtctggtccacttttgtcccctaaatctctcagctgactccaaactcctgaaatgtcacaaggaaacttgttctaactggtcaaaaagtgactgctgttgttatctttctagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggtgagtaagccagggttatgggtggtagtgaatgtgagggtaaagtg

SEQ ID NO: 12781 - DNA, 393 bp, Homo sapiens
  misc_feature 26, 50, 78, 90, 186: n = A,T,C or G
ccgccgccgctgctgctccttacagncctggtcagtcgccgctgcccggncggggtgcgagtttgagcggaaccccgncgccacctgcgnggacctgcagctcaggacctgcagcgatgccgtctacaaccacaccaccttccccaacctgcttcagcaccggtcgtgggaggtggtggaggccanctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttga

SEQ ID NO: 12782 - DNA, 378 bp, Homo sapiens
  misc_feature 19, 44, 51, 229: n = A,T,C or G
ctgtttttggcgcgcctgnaggccgacactagtggatccaaagnaattttncacgagatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggnggtaatttcaagaagagcgtttatccactattgattttcaagaaagaaaccaagcagcattgaaatcatgagtaacagaattcagaacattgtatggtggaagtcatttgtgtctgcagctgttttttcactttgcaataaataagagt

SEQ ID NO: 12783 - DNA, 209 bp, Homo sapiens
  misc_feature 17, 42, 44, 68: n = A,T,C or G
cgcgcgcctgcaggtcnacactagtggatccaaagaattcgntncgagcgtgtttctttattttgaanataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 12784 - DNA, 141 bp, Homo sapiens
tgaaaacattctcctccgcataagcctgcgtcagattaaaacactgaactgacaattaacagcccaatatctacaatcaaccaacaagtcattattaccctcactgtcaacccaacacaggcatgctcataaggaaaggtt

SEQ ID NO: 12785 - DNA, 319 bp, Homo sapiens
  misc_feature 14: n = A,T,C or G
ccccatgaagcttntttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctct

SEQ ID NO: 12786 - DNA, 385 bp, Homo sapiens
  misc_feature 41: n = A,T,C or G
cgcgcgcctgcaggtcgacactagtggatccaaagaattcnttacgagctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatc

SEQ ID NO: 12787 - DNA, 338 bp, Homo sapiens
  misc_feature 2, 43, 328: n = A,T,C or G
tngcgcgcctgcaggtcgacactagtggatccaaagaattctncacgagccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctcctttttttttgtccgccacacgtaactgagatgctcctttaaataaagcgtttgngtttcaagtt

SEQ ID NO: 12788 - DNA, 100 bp, Homo sapiens
  misc_feature 14, 35, 40, 41, 55, 59, 80, 91: n = A,T,C or G
gcgcgcctgcaggncgacactagtggatccaaagnaattnnttacgaggctgaantacncgctaacacgccttcagggtnctttcattacntcccgaagc

SEQ ID NO: 12789 - DNA, 400 bp, Homo sapiens
  misc_feature 2, 10, 39, 41, 42: n = A,T,C or G
gngcgcctgnaggccgacactagtggatccaaagaattntnnacgagttctttgtatttttttgtcctcattaaccatccccacctcctccctatcccctcactacctttcccagcttcttgtaactgtccttcatgacatccttcattagttcatccatgagttcaattgttttgatttttagatcccacttataagtgacaacatgcagtgtttgtctttctgtgcctggcttatttcacttaacataatgatctccagttccttccatgttgttgcaaatgacaggatctcattcttttttatggctgaatagtactccattgtgtatatgtaccgcattttatttatttacttatctgttgatgggcacttaggttgcttccaaatctttgctatt

SEQ ID NO: 12790 - DNA, 203 bp, Homo sapiens
  misc_feature 15: n = A,T,C or G
cgcgcgcctgcaggncgacactagtggatccaaagaattcttacgagcggtcctggaattcttccttgttctcccaaatttataacagtcctcaattgcagtttaagttcagcatggcccctcatctgcttgcctgattggaaatgcagccagtccaagtgttacaaattgggatttttttgttttctaaataaaaacatgta

SEQ ID NO: 12791 - DNA, 400 bp, Homo sapiens
  misc_feature 4, 29, 67, 69, 70: n = A,T,C or G
cttntttgggaaaaaccctggtttttcgngcgcctgcaggtcgacactagtggatccaaagaattcntnncgagacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagc

SEQ ID NO: 12792 - DNA, 110 bp, Homo sapiens
  misc_feature 110: n = A,T,C or G
caacgcccggctcttcggcctacgggcaaaaagagccaaggaagccgcagaacaggatgttgaaaagaaaaaataaagccctcctggggacttggaatcagtcggcaaan

SEQ ID NO: 12793 - DNA, 168 bp, Homo sapiens
  misc_feature 122, 149: n = A,T,C or G
ctctccttcactttggcatcagttgttttctatgaaaacagtggattggttgggttttgtgcagggtcttgggttagagccaaaatggatttgaggatgagtatttttttttttggttttgnatattttgtacattaataataaacagnggaaagagaagcagcttat

SEQ ID NO: 12794 - DNA, 400 bp, Homo sapiens
  misc_feature 2, 14, 42: n = A,T,C or G
gngcgcctgcaggncgacactagtggatccaaagaattcttnacgagcattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctag

SEQ ID NO: 12795 - DNA, 396 bp, Homo sapiens
  misc_feature 9, 14, 314: n = A,T,C or G
ctcgtgccnaattnggcaccagcccagactgaagatcatataactaaagcatgtgtcagtgagaaagagcactgagtgaactgaaaggaaatattgatgatgctgaccttggatcaagggtgcccttccactgtctccatctgtgtggtcctggaggcaggtctaattatcttgtgcagatgaaagaattaggatgtcataacctgactcatggaaaatctgcatactagatttgattgcttctgctcttctatgtttatacaacaaagttactaaatgtaatttggctaatataatttttgtcttatgtaagntatataagcctcttaacaatatgtctctttctacaaattctgttttataatcattctcagaacaaccacagctaccattttt

SEQ ID NO: 12796 - DNA, 395 bp, Homo sapiens
  misc_feature 2: n = A,T,C or G
gngcgcctgcagggcgacactagtggatccaaagaattcttacgaggggacgccgagggcggctgcgacgcgccgagaggccgcggctctcccacctgtcaccctggcccttctctgcttggatggtgtcttcctctcctcagccgagaatgacttcgtccgccggatccaggaggaactggaccgctttctgctgcagaagcagctgtcaaatcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtc

SEQ ID NO: 12797 - DNA, 328 bp, Homo sapiens
agcatgtcagctggctaaaagattgcaaaatccagaagatgatctcgatgtgtctgttcaatttagcaagggtatctactaggggatcctcttttaaatatggaggcccaaatcagaagcttgtagaggggagctattcttccaagattccagatgtgtctgtgagacaacacgttatggggcaaattgatttcacccttgggaaaccagggagattttcaaagttatgtctgcaaagccagctaatgcaattccccattagtgcattaaagtgcgcccttattaattcaaacataaaggcaacaaaataagcttttaaatttaaaat

SEQ ID NO: 12798 - DNA, 328 bp, Homo sapiens
gcaccatggcccgcggggctgcgctggcgctgctgctcttcggcctgctgggtgttctggtcgccgccccggatggtggtttcgatttatctgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcag

SEQ ID NO: 12799 - DNA, 324 bp, Homo sapiens
  misc_feature 221: n = A,T,C or G
gatggtgaacctttgggaatagttcttatcaacttaattggatacttttagcaaataggaacttaattctcagcactgaacatgaattacttccttggagtttttttcattcatatttttgttgtttccaggaatttatttgatattaatgggcgtaaaacagcatcattgtacttaagctatggatgtttttattttatattttctttatttataactgngccaagtattattttgctacttaccgtgttattctgtggaaagaaaaacctgtaaagtgtttaataaattagccctccttacataaattaaatgtcaaaattt

SEQ ID NO: 12800 - DNA, 395 bp, Homo sapiens
  misc_feature 347, 350: n = A,T,C or G
ccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcgggaacaagtccacggagtnccntgcaggccaacgtgcagcggctgaaggagtaccgttccaaactca

SEQ ID NO: 12801 - DNA, 331 bp, Homo sapiens
  misc_feature 14, 66, 320: n = A,T,C or G
gcgcgcctgcaggncgacactagtggatccaaagaattctttacgagctcagggacagtgcacgcnggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcggggttcgaccacttggccgatgggaatggtctgtcacaatctgctccttttttttgtccgccacacgtaactgagatgctcctttaaataaagcgtttgngtttcaagtta

SEQ ID NO: 12802 - DNA, 312 bp, Homo sapiens
ggcgggtggcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttgggaagttccaaagttgcaacgatttctggctagtgccacgaggt

SEQ ID NO: 12803 - DNA, 136 bp, Homo sapiens
  misc_feature 95: n = A,T,C or G
atctgcttcatccgccaactaatatttcactttacatccaaacatcactttggcttcgaagccgccgcctgatactggcattttgtagatgtggnttgactatttctgtatgtctccatctattgatgagggtctt

SEQ ID NO: 12804 - DNA, 398 bp, Homo sapiens
  misc_feature 19, 33, 59: n = A,T,C or G
ggaaaaaccctggtttttngcgcgcctgcaggncgacactagtggatccaaagaattcnttacgagtccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagg

SEQ ID NO: 12805 - DNA, 342 bp, Homo sapiens
gaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaag

SEQ ID NO: 12806 - DNA, 398 bp, Homo sapiens
  misc_feature 3, 15, 40, 42, 43: n = A,T,C or G
tgngcgcctgcaggncgacactagtggatccaaagaattntnnacgagccacaccagggtctgtcctggtcctcaagccacgcacccgctatgcctgcactgcagcccagccccggacagctccaggatccgtgcagtggctgcgccgccaggccccaacaatggggaccctggggtggctcctggccaagtgttctctgttttcctcgcacctccttacactgtgtgacctgcagggcatgaggaattgatgtgttcgggtttcctttcccaagccagcagatgcaggtgttccaaggtgtgttgctctgtgggatttgtggacacttaagaaacggactgagtgggaaccctgcagccaggggatggggagcctctgctccccccatgctcccacc

SEQ ID NO: 12807 - DNA, 100 bp, Homo sapiens
  misc_feature 41, 77: n = A,T,C or G
ctgcacgttagactacattaccttacattccaatgaatccncagaccattctaatccatcccttcacttctgctcgnatcgccatgcctatcatcttata

SEQ ID NO: 12808 - DNA, 336 bp, Homo sapiens
ccttgatgaacatagatgccaaaatccttaacaaaataccagctaactgaatccaacaacatatcgaaaagataatccaccatcatcaagtgggtttcataccagggatgcagggatggtttaacatacacaagtcaataaatgtgatacaccacataaacataatttaagacaaaaattacatgatcatttaaatagatgcaaaaaaaagcttttgaaaaaaatccagcacccctttatgattagaattctcagcaaaatcagcatacaaggggcataccttaatgtaataaaagccatctaagacgtacccacagccaacataacactgaatgg

SEQ ID NO: 12809 - DNA, 100 bp, Homo sapiens
  misc_feature 6, 10, 11, 59: n = A,T,C or G
ctgcgngccnnggttgaaggagtgccggtgcaaacttatcctcttaccctgtaagcccntggggccctaagaagggagacaggtctgctgaagaactgaa

SEQ ID NO: 12810 - DNA, 100 bp, Homo sapiens
cactaggggattcaaggaattcgggacgagggcaggaagtcccaatgctggatgatgagatgctgacctactgaagtacggaggggccacagcagacaaa

SEQ ID NO: 12811 - DNA, 330 bp, Homo sapiens
ccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggttttcattgtacctgaca

SEQ ID NO: 12812 - DNA, 107 bp, Homo sapiens
  misc_feature 33: n = A,T,C or G
tgcggacgaccccgcgacctacatacttgcctncttgttcccgttagacaataaagacttgaggactgggggggcgccctggggcactgacagagtgtgagtgaaag

SEQ ID NO: 12813 - DNA, 100 bp, Homo sapiens
  misc_feature 44, 56, 91, 92: n = A,T,C or G
ctgctgacccttaaaacattacgaaggagtcttcggaattttgnagatctagcgcntgagaacgaagtttgcccgtttgatgcttcgaagnnccaggagg

SEQ ID NO: 12814 - DNA, 356 bp, Homo sapiens
  misc_feature 4, 11: n = A,T,C or G
atcnaaagtanttcggcacgagcggcacgaggcattgttctttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgtttttgatgccatttgtcttttgtaaagttaattattaaaagtttttat

SEQ ID NO: 12815 - DNA, 177 bp, Homo sapiens
ggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaaga

SEQ ID NO: 12816 - DNA, 100 bp, Homo sapiens
  misc_feature 42: n = A,T,C or G
taccgggggtccgtgatgctgtcatagttgtccatctttccnttgcgcacaggctcatggggtaacaagataacaaaaccccacactgtccctttgaagg

SEQ ID NO: 12817 - DNA, 113 bp, Homo sapiens
  misc_feature 5, 47, 76, 103: n = A,T,C or G
gcccnactctgcggatgcgcccacccatacccttcctaacatagaangaatgaaaggtacatttacgatttttcgnaattgcccatcctcatttgcttaatancttggtacat

SEQ ID NO: 12818 - DNA, 327 bp, Homo sapiens
  misc_feature 320: n = A,T,C or G
atttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggttttttatttggatttagcgcattcaaagcttttttctatcacttttgtgttcagaatataacctttgtgtgcgtgtatgttgngtgtgtg

SEQ ID NO: 12819 - DNA, 324 bp, Homo sapiens
ttcggcacgagtgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaaggaaggcctttcttctgtgttaattgcgtagaggctacagggggttagcctggactaaagg

SEQ ID NO: 12820 - DNA, 103 bp, Homo sapiens
  misc_feature 59: n = A,T,C or G
aaactaaaaatctgcttcccagcctctgagtgactgaatctcattgactcgttcgatgnacccatactccctactttctatcttaagctgatggccgcataag

SEQ ID NO: 12821 - DNA, 104 bp, Homo sapiens
  misc_feature 41: n = A,T,C or G
gtgtgtatctagacgaatcacatgattgatatttagcaacntgccaaagtagaacaacgaactaatgctgtcaatgctttaaaattatttacttggcttcaagg

SEQ ID NO: 12822 - DNA, 291 bp, Homo sapiens
  misc_feature 152, 176, 198, 225, 241, 244, 259: n = A,T,C or G
ttcggcacgaggtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggngtttttttttttccaatatgaacncatgcaaggttaccaaaactgngataacccttttttacttactgtaaanagtcattttcataaanatnaattcattgatttgntttttttggaaagctatcattcaatatatatt

SEQ ID NO: 12823 - DNA, 104 bp, Homo sapiens
aaagacctcaccattggctcgtagcttcaagatgctgaaattgcgaggttgctgggatacttggaccgtagcacggaccacaggggcgaacttgcaagattatg

SEQ ID NO: 12824 - DNA, 100 bp, Homo sapiens
  misc_feature 20, 40: n = A,T,C or G
ctcgggacgagggttcgagnatatcagggactcacggacntaaaaggctcaaaggcgcctggcggtcggtcaatccttaaaaactctatggaatcctacg

SEQ ID NO: 12825 - DNA, 100 bp, Homo sapiens
gccttgcgcggcggcactaggggactcgaggaatctcgggccgaggggactcgaagcaatcagcaacaaaagcaaggcaaaaaaagcaaagaggaaaaga

SEQ ID NO: 12826 - DNA, 100 bp, Homo sapiens
atacatggcgaccccatgggtttctgagacctgaaaagccctgccggcctgcaggtgctcaacgattacctggcggccaagagctacatagaggggtatg

SEQ ID NO: 12827 - DNA, 331 bp, Homo sapiens
caggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtgccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtggggggatttaaaggc

SEQ ID NO: 12828 - DNA, 358 bp, Homo sapiens
  misc_feature 121: n = A,T,C or G
cgactcccggagttcatcgtgcagacgagctcctacatgttcgtggacgagaacacgttctccaacgacgccctgaagcccagcccctccatgcacatttggacgctgtcctgcacttcangtgcaagctgggctcctgttacatactggacagaccacccacagccgctgctgccaaccccacctccactcctccagactgccagccaactacatcattctgcccacagacctacgctaccactgccatcgccatccaccgcatctcaccaacagactgtggctcctagtgatgtggactcacctcggaggtatccgagctggacacagccccctggacagtgatccagacagctgg

SEQ ID NO: 12829 - DNA, 100 bp, Homo sapiens
  misc_feature 66: n = A,T,C or G
tcgggcgcttgcgcgccggcactaggggactcaaggaattcgggacgagctcgcgccctattgccnacgacatgctcagatgccactctagtcatcggag

SEQ ID NO: 12830 - DNA, 100 bp, Homo sapiens
  misc_feature 11: n = A,T,C or G
tgtgtgcttangtaccgagcccctgaactgctgatgtgaaccagcacaccaaccaccagcactacacatgtgggctgggggctggatactggcctacctg

SEQ ID NO: 12831 - DNA, 126 bp, Homo sapiens
ccgccagagggcttgtgaacagaccggagaggacagtggattgtttatactccagtgtacatagtgtaatgtagcgtgtttacatgtgtagcctatgttgtggtccatcagcccctcacattccta

SEQ ID NO: 12832 - DNA, 334 bp, Homo sapiens
ggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaatttttgtatctagcctaaagtttccctaggctttcttgtctcagcaactttcccatcttgtctctcttggatgaatgtttgccgtcagcattcaccaaataaactt

SEQ ID NO: 12833 - DNA, 104 bp, Homo sapiens
  misc_feature 2, 69: n = A,T,C or G
tngagggattagaaagatgatactgtggtgctggcgctggacttacgaggtgacgagttgccttacttnctacctttggagcgctgcaatcttaattttcacga

SEQ ID NO: 12834 - DNA, 100 bp, Homo sapiens
  misc_feature 41, 73, 74, 75: n = A,T,C or G
acaaatttgcacaattggcccggtgagctgaggacactttntacctgtaaacagaaaaaactgagaacctggnnncatatattcggagatagtgggatca

SEQ ID NO: 12835 - DNA, 101 bp, Homo sapiens
tatcctggtgtatctggaggatcacaggggatagggggatagcacaataaaactacagacctactgctgatgcggtgacccatgcacagaaacttggggac

SEQ ID NO: 12836 - DNA, 100 bp, Homo sapiens
  misc_feature 27, 59: n = A,T,C or G
cagatctccagatggccacaggccctnaagggaaattggggatatggaaggatagaatnatttctctgccttatcgcccgaatatatggatataaaggta

SEQ ID NO: 12837 - DNA, 291 bp, Homo sapiens
  misc_feature 244: n = A,T,C or G
gcacagaggggtttgtccagcgccacatgcccaccatccggtgccagcccagcgggcactgggaggagcctcggatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggggncctcttcttgtcgctttttgtcatataaggaatcccattaaaaaaaa

SEQ ID NO: 12838 - DNA, 336 bp, Homo sapiens
caaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggca

SEQ ID NO: 12839 - DNA, 100 bp, Homo sapiens
  misc_feature 2: n = A,T,C or G
gngactgcgcccttgaaagactgggaaatatgctataatgccgggggcactagagaacgggagagagggagaagctatataagctatatggagaccactg

SEQ ID NO: 12840 - DNA, 100 bp, Homo sapiens
  misc_feature 52: n = A,T,C or G
tggagcgcgggcgcttgcgcgccggcactaggggactcgaggaatccgggangagggaaggtctgcctctgagggcacggagagaacccaaactcccaaa

SEQ ID NO: 12841 - DNA, 294 bp, Homo sapiens
ctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatga

SEQ ID NO: 12842 - DNA, 100 bp, Homo sapiens
ctctattttatgattttttgcagatgttcagaagcctagagaccgagtcaatgcgacgatgaatcggctaccatgctcacatgtactgatagcctgggcc

SEQ ID NO: 12843 - DNA, 109 bp, Homo sapiens
  misc_feature 78, 80: n = A,T,C or G
aacgctctatggcccgactatccgaatattaagataataggatcatgggttgaagcagcggggccagggcacctggtntntagaattttgcagttttgcataaatctgt

SEQ ID NO: 12844 - DNA, 229 bp, Homo sapiens
  misc_feature 218: n = A,T,C or G
tggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgngggtttttttt

SEQ ID NO: 12845 - DNA, 222 bp, Homo sapiens
  misc_feature 54: n = A,T,C or G
ttcggcacgagtttagggacattctagtatttgcttctattgtttgggccttgnggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattc

SEQ ID NO: 12846 - DNA, 102 bp, Homo sapiens
  misc_feature 2, 10: n = A,T,C or G
angagcgganaatcacttgctcacttggcccatttttgcatctttgggagtgacgcttgcacattcgagcattgcagggaggagcaccagcagcccctatgg

SEQ ID NO: 12847 - DNA, 100 bp, Homo sapiens
gctgctgcgctcgtgcgccaggacggcggagctgtggactggtattatgaaagtaccacggcgcccactcaaattctctgatcctctgaaggtggagaag

SEQ ID NO: 12848 - DNA, 100 bp, Homo sapiens
gcccccacaggcactatggcagtaccacctcggctacctacttacctttggaggtgcgctgttgcctggtttttggggctctgaagctgtgagaccgtga

SEQ ID NO: 12849 - DNA, 100 bp, Homo sapiens
  misc_feature 73: n = A,T,C or G
accgaaaggctggagctcgggcgcttgcgcgccggcactaggggactcgaggaatccgggacgacggctcgangaatttattgcttatttaacagagata

SEQ ID NO: 12850 - DNA, 335 bp, Homo sapiens
cccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaaggaagtcaacttgctgttcagcctcagaataaaggtgccgttca

SEQ ID NO: 12851 - DNA, 105 bp, Homo sapiens
ctcgcgccgtttgtttcttgggcaagcaggaaaaattaaattgtacctattttgtatatgtgagatgcttaaataaattgtgaaaaaaatgaaataaagcatgtt

SEQ ID NO: 12852 - DNA, 103 bp, Homo sapiens
  misc_feature 90: n = A,T,C or G
actaggggactcaaggaatctcgggacgacaattcgagaagttgataagtatttagatagctggaatgcagcatgagggcatgacccaancatccaaacataa

SEQ ID NO: 12853 - DNA, 100 bp, Homo sapiens
tggagatcgggcgcttgcgggccggcactaggggattcaaggaattcgggacgagggctccaggagccttacctttttaacgtgtcttaaaagaaatgca

SEQ ID NO: 12854 - DNA, 330 bp, Homo sapiens
gcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccaca

SEQ ID NO: 12855 - DNA, 336 bp, Homo sapiens
  misc_feature 316: n = A,T,C or G
cgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataaatggngtgacccttcacctttgatc

SEQ ID NO: 12856 - DNA, 100 bp, Homo sapiens
  misc_feature 29, 40, 46: n = A,T,C or G
aaagctggagttctggcgcttgcgcgccnacactatgggnattcangaattcaagacgagctcaagggcccttggcccatttgaccgaactgcactgcga

SEQ ID NO: 12857 - DNA, 101 bp, Homo sapiens
gtctaatggcctaatgtgcggagctgacagtgccgatatgcagagtggatacagtgtaacattagcactttgggcgtccggaggcccactacaaaatgaag

SEQ ID NO: 12858 - DNA, 100 bp, Homo sapiens
  misc_feature 54, 96: n = A,T,C or G
aaggaattcggttcgagggtatgagcttctgcgctaccagagagacattgtganttactgctcacacactcacacacgcacacactctcacactcncaca

SEQ ID NO: 12859 - DNA, 102 bp, Homo sapiens
  misc_feature 7, 15, 78: n = A,T,C or G
aagaggngaagctgnaggcctaatacccaagacctacgaccacaagcctggaggcttggactttctcatgaacagacnacaaaacgggggatggggcatagg

SEQ ID NO: 12860 - DNA, 237 bp, Homo sapiens
agagaagagtacgaaggcccaaacaaaaaaccccgattttagatgtgatatttaggctttcattccagtttgttttgtttttttgtttagataccagtcttttaaattcttgcattttagtaagaaagctatctttttatggatgttagcagtttattgacctaatatttgtaaatggtctgtttgggcaggtaaaattatgtaatgcagtgtttggaacaggagaatttttttttc

SEQ ID NO: 12861 - DNA, 305 bp, Homo sapiens
  misc_feature 56, 225: n = A,T,C or G
aaggtatccatgagactggaagctaactcaaaaatcattctagagtcttctctggngtcctatacttaaggcttggtgatggcagtagcaagaatttatgattcaaaaacattacggttcactggatggtacatctgtttatagatcatttgagcccaacagaatagtttgaacagattatataacctatgctactctgtaacttaaacaaaagtgtttggcggngggcaccgtggttcacacctgtaatcccagcactttgggaggctgaggcgggaggatcacctgaggccaggagttcgaga

SEQ ID NO: 12862 - DNA, 100 bp, Homo sapiens
  misc_feature 60: n = A,T,C or G
aaaaggctggagatcgggcgcttgcgggccggcactaggggactcaaggaattcgggaangagctggcgacaggcagcacggcaactccgaaggtcacca

SEQ ID NO: 12863 - DNA, 265 bp, Homo sapiens
  misc_feature 198, 207, 225: n = A,T,C or G
atcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatganaagatgaanagcttggatgtgaatcangactcggagctcaagttcaatgagtactggagattgattg

SEQ ID NO: 12864 - DNA, 286 bp, Homo sapiens
cgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggt

SEQ ID NO: 12865 - DNA, 100 bp, Homo sapiens
  misc_feature 2, 37, 52: n = A,T,C or G
anttttattagcactaaggcattagcactggtgggangggtggagacgggcntgaggcccagaacgagagtgcgagagtgcgagccaccttgccaagtgg

SEQ ID NO: 12866 - DNA, 100 bp, Homo sapiens
  misc_feature 67, 77: n = A,T,C or G
gatagagcggttgcacctctttgcctatgtgtctcaagagtgacaaggcgcctgggtcacattgacngaggtacggnggatctgtggctccaggggagac

SEQ ID NO: 12867 - DNA, 101 bp, Homo sapiens
gctggaaatctggcgcttgcgcgccgacactatgtggattcaaagaattcaggactacgacacctggagcgccggcgcgggaacatcctactgtactcaat

SEQ ID NO: 12868 - DNA, 100 bp, Homo sapiens
tggtacctcgcctaattgcttcatagtatcctgaactctgaagctgtgaaattctctaataccctaagagcgggagtgtgtgagggcatggccccaggca

SEQ ID NO: 12869 - DNA, 300 bp, Homo sapiens
  misc_feature 2, 11, 52, 173: n = A,T,C or G
gngaatcccangacaaggcccaccaccctggcccacccaaggttgtgcccanagtggggaatgagagagaggggcctgagagcaacctggattctgggcctgagtcgggcacggggaccacagacccctctctggcagaagccctcgcggccacctgcatcgccatgccaggntgggcgctgacaccgagacacacacctggaactgatatactggaggaaatagttcgttgcggttggcgtgtctgcgctggggtgtccagcatttctccatgtcggcttcgtccacgctctcatttat

SEQ ID NO: 12870 - DNA, 330 bp, Homo sapiens
  misc_feature 134: n = A,T,C or G
aggacatgaaaaccagcagaaaggccctgagctgctgcatagccccatctgatttctgcagttcccgccagcctccaacacggggactctgccgtaactggaatcttcataggtcatattgaaatcttcaaggngaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctga

SEQ ID NO: 12871 - DNA, 100 bp, Homo sapiens
gcttgcgcgccggcactagggcactcaaggaatccaacacgagggcactactgtgatgctgtaatatactcaatacacgcggtgaggggccgttcggaca

SEQ ID NO: 12872 - DNA, 108 bp, Homo sapiens
  misc_feature 95: n = A,T,C or G
gctggagctctggcgcttgcgcgcctacactatgtggattcaaagaattcaggactagcatctgaggaggtgccgcggccaaaatgcacaatttncgtgaaaaccctt

SEQ ID NO: 12873 - DNA, 133 bp, Homo sapiens
tgggagtcaaattttgggggcttaaagatcacctggagtgtgtgttagaaacacagactccagtttcattccagtaattcttattcattgggtgcccctatgaatgggctttttttttttttttttttttttt

SEQ ID NO: 12874 - DNA, 338 bp, Homo sapiens
tggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccatctcaaggtgtttgacggcatcccaccgccctacgac

SEQ ID NO: 12875 - DNA, 100 bp, Homo sapiens
taaggacttaagttatgactttataaagccctagaggaagcgccgatggctggatcagatgggacttgcggacgtgctgtagaaatttggaggctagggg

SEQ ID NO: 12876 - DNA, 112 bp, Homo sapiens
  misc_feature 6, 9, 30, 31, 33, 38, 44, 45, 47, 50, 54, 58, 59, 76, 84,112: n = A,T,C or G
aaatcnggngcttgcgcgccgacactaggnnantaaangaattnnanaanaggnttcnnccatccccatgttcctntgattctntaaaaagtgtaaagaactgcagccctgn

SEQ ID NO: 12877 - DNA, 100 bp, Homo sapiens
  misc_feature 7, 19, 28, 29, 31, 42, 43, 45, 49, 51, 52, 55, 56, 61, 62,65, 70, 72, 76, 77, 83, 89, 91, 96, 97, 99: n = A,T,C or G
atctggngcttgcgcgccnacactaggnnantaaaagaattnnanaaananngcnnaagtnnggnggtgngnttgnngccatnccaatngntgaanngnt

SEQ ID NO: 12878 - DNA, 270 bp, Homo sapiens
  misc_feature 20, 224: n = A,T,C or G
ggcaacctgaaaaaggctgncattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgnggacattggcccagtctgtttcaaataaatgaactcaatctaaatt

SEQ ID NO: 12879 - DNA, 169 bp, Homo sapiens
  misc_feature 143: n = A,T,C or G
ggcaggtttaatggccagtttaaaacttatgctatctgcggggccattcgtaggatgggtgagtcagatgattccattctccgattggccaaggccgatggcatcgtctcaaagaacttttgactggagagaatcacagatgnggaatatttgtcataaataaataatg

SEQ ID NO: 12880 - DNA, 105 bp, Homo sapiens
  misc_feature 32, 72, 81: n = A,T,C or G
cacaagcttacctgctgccccccggggcgctnctgagattgtaatatcttttgaccttgaggccttggggcnactgaatgnctctgcggcggtcctgaggacggg

SEQ ID NO: 12881 - DNA, 128 bp, Homo sapiens
caggcaaacgagtatgtccatgtggacgtgaggaaggccccgagggacatgttgaaatccaaacagcgcatccatgcatgcctgcatgctggcatggtggccacagcatgacctggtggacgactctt

SEQ ID NO: 12882 - DNA, 339 bp, Homo sapiens
  misc_feature 15, 320: n = A,T,C or G
attatgccaaaatgntacttttcttggggacaaagagtatattaaacatttttgctagtttaatattttctatatttttcataagtacatatatcactgtagttagactacataaacaaaataaaatttatttttaaagaattgcatattatccattttttagtataggaaattaaatcacatatgtatctttttttaatgagtcactttttgttacttgactaagctataaaaatagaaatttgactatttgaaacatttgataaactaaaatttatagattaactttgaagttcatggattctctttgatcatgtggnagcctaatattctgaaaat

SEQ ID NO: 12883 - DNA, 278 bp, Homo sapiens
  misc_feature 20, 23: n = A,T,C or G
cgaaagtttatctgccatgntgngggtatcacttaccagcacattgaccgctggctgctggccgagatgctcggggatctgtcggacagccagctaaaggtgtggatgagcaaatacggctggagtgcccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcaga

SEQ ID NO: 12884 - DNA, 100 bp, Homo sapiens
  misc_feature 53: n = A,T,C or G
ctggcgcttgcgcgcccgcactaggggactcaaggaattcggttcgaggagcntactaggttatgggggcatgcttgcatgctcctatgaacccctttcg

SEQ ID NO: 12885 - DNA, 100 bp, Homo sapiens
  misc_feature 2, 11, 27, 28, 34, 38, 39, 41, 49, 50, 61, 62, 67, 68, 76,79, 80, 85, 89, 93: n = A,T,C or G
anagagatcantgatttattgctgggnncctgtntganngntctaaggnntgaagattatnncattnngcaagcgnacnngcgcngccnagcngaccagg

SEQ ID NO: 12886 - DNA, 348 bp, Homo sapiens
tgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacg

SEQ ID NO: 12887 - DNA, 106 bp, Homo sapiens
  misc_feature 47: n = A,T,C or G
tgaagcggttaatctctaaattttaaatatatatttatccttttccntgctaaccatccctaaaaccctactggacgactgggcgatggtggtagcatgtgagctt

SEQ ID NO: 12888 - DNA, 314 bp, Homo sapiens
  misc_feature 6, 164: n = A,T,C or G
ttcggnacgaggctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcnggcagagcagctactgactttgaacatgggcagagaggcccctggatctcatccagcccactccttttccccttccagtacagtgacactctggtgcccattggcagatggcgacttccctgcacccataactgatgctttgggaattct

SEQ ID NO: 12889 - DNA, 107 bp, Homo sapiens
  misc_feature 21, 48, 49, 50, 51, 59, 60, 63, 74, 86, 96, 98: n = A,T,C or G
gttctggctgctcgggtgccngcgagcctgcggaggtggttctgtgannnncctaaagnnctnactgttagacngtaaaatagaanccatgtttcnangacctgaat

SEQ ID NO: 12890 - DNA, 102 bp, Homo sapiens
catataatcatacgcggagaggcagagctcatgaatacaggtcctccccagatgacgccattttccaaattttgaaagggggatactgttcttttatcccgg

SEQ ID NO: 12891 - DNA, 100 bp, Homo sapiens
  misc_feature 19, 22, 30, 32, 38, 44, 46, 51, 58, 60, 61, 62, 65, 69, 85,95, 98: n = A,T,C or G
tggaaaaaagccgaagttnggngcttgcgngncgccantagggnantcaangaattcngnnntangggncaaccagggggcgagncagtggccanttnat

SEQ ID NO: 12892 - DNA, 227 bp, Homo sapiens
tctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatat

SEQ ID NO: 12893 - DNA, 398 bp, Homo sapiens
  misc_feature 14, 21, 37: n = A,T,C or G
ggaacaaaaagccnggagttngcgcgcctgcaggtcnacactagtggatccaaagaattcggtacgagtaaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggccccggggctcaagtgcgggaagg

SEQ ID NO: 12894 - DNA, 106 bp, Homo sapiens
  misc_feature 8, 24, 33, 34, 47, 48, 58, 63, 68, 71, 73, 77, 88, 95, 96: n = A,T,C or G
atatttcnggagcttgcagcggcnacactaggnnactaaaagaattnnagaaagaggnctatnggacnagnanacangaaacctgcanacttggnngcttggaagt

SEQ ID NO: 12895 - DNA, 340 bp, Homo sapiens
ctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacac

SEQ ID NO: 12896 - DNA, 182 bp, Homo sapiens
  misc_feature 4, 7, 31, 33, 53, 55, 56, 58, 59, 61, 85, 88, 120: n = A,T,C or G
aacnggncgctagtggatccaaagaattcgntncgagcgaagccacaattggntnngnngnaggaaaggaatctattcagtaagncancctcatcacatggaatggactggctatactgncattaaagaaggtaaacaactgtatcacttcagctgtcttatatttatgattcaggcatttc

SEQ ID NO: 12897 - DNA, 100 bp, Homo sapiens
  misc_feature 74: n = A,T,C or G
gatgtggagatgcttgataggttactgggcggcaatccaggagttgatgaagcgcatatgcgaacatttcacgngcatattgcggtgcaagggcttactg

SEQ ID NO: 12898 - DNA, 122 bp, Homo sapiens
  misc_feature 81, 91: n = A,T,C or G
ttttttttttgcttttacctagataaacttctagctaatcaaataaggaaagaaactgtctttttaaagcttcttttgggntagatactgnattagagatctgcatttatcatgagttcctt

SEQ ID NO: 12899 - DNA, 400 bp, Homo sapiens
  misc_feature 42, 44, 65: n = A,T,C or G
tgcgcgcctgcaggtccacactagtggatccaaagaattcgntncgagcaggaacccacttaggnggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatc

SEQ ID NO: 12900 - DNA, 356 bp, Homo sapiens
ggcctcccaaagtgctaggattacaggcatgagctactgtggccaacctaaatttatatgtaaatagccatatgtggctagtggctactgtatcagacctcacagttctgtacagataacgcacagcgcacagtagcatactatacacgccctactaaatcttgctttgttcccttaacggcacctatgcatcttggagatagattgtcccagtctgcctcatttttaaaaactgctgcataatatcctcttgtaatccacaaaggcaatcccagacccagcctggggggccatgggtcatcactttttacaacaagctctaaaatcttccacatataccataatcaaggcacttc

SEQ ID NO: 12901 - DNA, 336 bp, Homo sapiens
cgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgc

SEQ ID NO: 12902 - DNA, 334 bp, Homo sapiens
ctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagag

SEQ ID NO: 12903 - DNA, 297 bp, Homo sapiens
cccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactgaaaaatcgagagtacttctagagcggccgcgggcccatcgattttccacccgggtggggtaccagggt

SEQ ID NO: 12904 - DNA, 338 bp, Homo sapiens
gtcatctagagccaatttttttttgtttttgtttgttttgtttttaagcactctggataaggaaaaaatagacacttgtttttatatcatttttatgtacaatgtgaaaacagatttttaaaaaatttgttctctgtctttgttaacaaattccttccgatttatgtgggttcacctctcacgtttgctggatacttactttacaccatgttatgaaagatgctttgttttcatttcatgagtttgggctacaagaatactttgttttagctccaggtagatgccattgaaggcattcatggctgaaatcaattctaacacacttaccgatgaattga

SEQ ID NO: 12905 - DNA, 337 bp, Homo sapiens
cgggttacccgttgtattcgcatcaaccctaaaatggatcctctgattggacaggcagcacagcggattggacttgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatataagtctg

SEQ ID NO: 12906 - DNA, 115 bp, Homo sapiens
  misc_feature 25, 30, 61, 68, 94, 96, 97: n = A,T,C or G
aacggaggcaggttggagccgctgncgacnccatgacccgcgggaaccagcgtgagctcgnccgccanaagaatatgaaaaagcagagcgactngnntaagggaaagcgccgaga

SEQ ID NO: 12907 - DNA, 154 bp, Homo sapiens
gtagttttagtagagatggcgttttaccactgttggccaggctggtcttgaacccctgacctcaggtaatccacctgccttgtaatcccagcacccaaggcagatgatagcttgagcccaggagttccataccagcctgggcaacatagtgaga

SEQ ID NO: 12908 - DNA, 146 bp, Homo sapiens
cccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggt

SEQ ID NO: 12909 - DNA, 130 bp, Homo sapiens
  misc_feature 3, 23, 69, 82, 89, 92: n = A,T,C or G
aangttctttgtctgagtcaggnacatcctgttatccagctgctacatcccctttcagtgtgaattccnctccttaccaaancacttanaanacactttgacaagttttaaactcaaacactgaatattt

SEQ ID NO: 12910 - DNA, 132 bp, Homo sapiens
  misc_feature 46, 58, 61, 102: n = A,T,C or G
aagatatagtctgtggatggatcatctgatgatgatggataaattngatttttgcttnggntgggctcctcttggggatggattatggcatttaaaccatgncacagctgtgaagatctggcacaagataga

SEQ ID NO: 12911 - DNA, 147 bp, Homo sapiens
  misc_feature 1, 6, 23, 92, 114: n = A,T,C or G
naagtncctcactggtcaaaacnatcacccttgaggtcgagcccagtgacaccattgagaatgtcaaagccaaaattcaagacaaggagggnatcccacctgaccagcagcgtntgatatttgccggcaaacagctggaggatggtc

SEQ ID NO: 12912 - DNA, 339 bp, Homo sapiens
  misc_feature 248: n = A,T,C or G
agtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggnggagatgctggcaacagggaggaccagatcaacaggcttattagaagaatgaactaaggtgtctaccatgattatttttctaagctggttg

SEQ ID NO: 12913 - DNA, 336 bp, Homo sapiens
  misc_feature 2: n = A,T,C or G
gngctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtg

SEQ ID NO: 12914 - DNA, 212 bp, Homo sapiens
  misc_feature 3, 12, 66, 76, 106, 115, 154, 167, 203, 208: n = A,T,C or G
ccngtatcctgnctcccctaattgacattctatcagcccaaccctcattctgcagggccacctggngtgtggaggnggcggaaggactcatgtgactcttgggggnctcctcagngacccccatacctcatcatgaacccttgggtagcttgantctgcctaccatncaggaaaacttgtgctggaattgctgatggaaacanttaantatt

SEQ ID NO: 12915 - DNA, 110 bp, Homo sapiens
  misc_feature 8, 66, 91: n = A,T,C or G
gctgagcntgcctcctgtggcaccccaacaccccccaggccttgctaaacatggattggtttaggnttgttttgttttgttttgctttggncccttggactgctccctag

SEQ ID NO: 12916 - DNA, 397 bp, Homo sapiens
  misc_feature 2, 50, 61, 77, 78, 92, 94, 97, 98, 104, 107: n = A,T,C or G
ancgaaaagcctggagcttcgcgcgccctgcaggtcgacacctagtggantccaaagtacntcggcaccgaggtaanntcagtacctctctnanaanntagctnacnttacactacttacaggcaccaagggagcccacttgatgtgaagtttcagtgaaacagtgtaaagaaatgatgttagttaaatatcactatttctcaaagtaaaggatgtcattgtattagtagaatgttaaccctctcttttatggggtcagttacatcaacttcatcataaaccctcttcaaaaaacatgcattttaggacttggatataggtcaggtctgtgtttcattaagcatttgttcagattccagctctcttgctccacaaccattgatatttctcaatttat

SEQ ID NO: 12917 - DNA, 333 bp, Homo sapiens
  misc_feature 16: n = A,T,C or G
gttttacacttttaantttcccttcttacttgtaatttttttctttaaataaggaaaccaatataatctcatgtataaaaacttaaatattttacaagttacatatagcatcattctaaaataagaattttttttgttttctgtctgcttttttcttatgtctcttgttgagttttatatttttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagac

SEQ ID NO: 12918 - DNA, 214 bp, Homo sapiens
  misc_feature 17, 22, 26, 43, 92, 115, 116, 171, 201: n = A,T,C or G
ctcgtgccgaattcggnacgancctnacacccaattggaccantctatcaccctatagaagaactaatgttagtataagtaacatgaaaacnttctcctccgcgtaagcctgcgnnagattaaaacactgaactgacaattaacagcccaatatctacaatcaaccaacangtcattattaccctcactgtcaacccaacncaggcatgctcat

SEQ ID NO: 12919 - DNA, 337 bp, Homo sapiens
gctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgt

SEQ ID NO: 12920 - DNA, 179 bp, Homo sapiens
  misc_feature 48, 97, 115, 116, 118, 156, 173: n = A,T,C or G
ggggtacaaatatctgttcctgtctctcctttcgactttttgggatgnatactcaaaagcggaattgctggatcatattttctatgtttaatttttngaggaaccaccatactgnntnccagagcggctgtaccattttacattctcaccaaaagngcataagagttccaatntctcca

SEQ ID NO: 12921 - DNA, 179 bp, Homo sapiens
  misc_feature 2, 57, 64, 79, 84, 85, 130, 132, 134, 160: n = A,T,C or G
angatgaagctgacagaagagggaaagtgtatgataaatacatgtgcggctttctgntcaactngaacaatgattttgnggtgnntgcaacccgcaagggtaacaaaattcgttttgcaaatcattcggnananccaaactgctatgcaaaagttatgangggtaacggggatcacagg

SEQ ID NO: 12922 - DNA, 165 bp, Homo sapiens
  misc_feature 13, 35, 71, 90, 111, 127, 132: n = A,T,C or G
cctgttccaaggnggcaaggaggcaatgcggcggncacagattgacaagaaaggacgggctgtctcatggnccttctctgaggagaatgngatccgagaatttaacttaantgagctataccagcgngccangaaactatcaaaggctggagacaatatccctga

SEQ ID NO: 12923 - DNA, 339 bp, Homo sapiens
gaacgttagatattttttttccatggggtcaaaaggtacctaagtatatgattgcgagtggaaaaataggggacagaaatacaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattc

SEQ ID NO: 12924 - DNA, 120 bp, Homo sapiens
  misc_feature 108: n = A,T,C or G
gagaactagtctcgagagtacttctagagcggccgcgggcccatcgattttccacccgggtggggtaccagggtaagtgtacccaattcgccctatagtgagtcgatnctttttcactgg

SEQ ID NO: 12925 - DNA, 335 bp, Homo sapiens
gatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgt

SEQ ID NO: 12926 - DNA, 234 bp, Homo sapiens
gccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagg

SEQ ID NO: 12927 - DNA, 126 bp, Homo sapiens
  misc_feature 3, 25, 30, 37, 49, 54: n = A,T,C or G
ggncctcaaggcgacttgaagaccnttggntgcttgngccctgccctgngcttngggggaaaggatagactggattgtcagtttatttctagggcaagattttatctctctgttgtgtccatagct

SEQ ID NO: 12928 - DNA, 246 bp, Homo sapiens
caccagtcaaagcgaactactatactcaattgatccaataacttgaccaacggaacaagttaccctagggataacagcgcaatcctattctagagtccatatcaacaatagggtttaccgacctcgatgttggatcaggacatcccgatggtgcagccgctattaaaggttcgtttgttcaacgattaaagtcctacgtgatctgagttcagaccggagtaatccaggtcggtttctatctacttc

SEQ ID NO: 12929 - DNA, 328 bp, Homo sapiens
atagaaataagggaggtctagagcttctattccttggccattgtcaacggagagctggccaagtcttcacaaacccttgcaacattgcctgaagtttatggaataagatgtattctcactcccttgatctcaagggcgtaacctctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagactt

SEQ ID NO: 12930 - DNA, 178 bp, Homo sapiens
ggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatatctcaaagtaaagtcatt

SEQ ID NO: 12931 - DNA, 400 bp, Homo sapiens
  misc_feature 15, 17, 36, 42: n = A,T,C or G
cgcgcgcctgcaggncnacactagtggatccaaagnaattcntcacgagttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatca

SEQ ID NO: 12932 - DNA, 400 bp, Homo sapiens
  misc_feature 41: n = A,T,C or G
tgcgcgcctgcaggtcccactagtggatccaaagaattcgnttcgaggaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgc

SEQ ID NO: 12933 - DNA, 397 bp, Homo sapiens
  misc_feature 2, 16: n = A,T,C or G
gngcatcctccaattntcatcgttccattactcccttttgtgctacaggtgatctctttactctctctttgcttcctaaagctctgtgtaggcttttggttgaactctgctcctgtttaaccacctcattttacagataaggaaactgagaaccagagagattaagtattatgttcacacagctaggatccggactgagacccaagtctcctatgccatgccacagcaccaattttcttcatgtaaattttgctcttagcaatacaatggaacacatggatacaaaatttttaacatctcatttagtgtgaaaacagataaatattattatgcctctgcttttctcaaagacaactgtgttaataataacaacgacctgatttcttgatcctagcag

SEQ ID NO: 12934 - DNA, 400 bp, Homo sapiens
  misc_feature 3, 17, 42: n = A,T,C or G
tgngcgcctgcaggtcnccactagtggatccaaagaattcgnttcgagaaatattattttttattatcctttgttctcttttctcaataattaggatgatcttaattgacaaaaatcataactttgcagccttccttttccaagcctcaaatctctgctaggagttaataacccatatgtactttttttcccccagcacagctaagtcattttccatggattccaataggaggtttaaaggatagattttaggctgggcatggtggctgacgcttgtaatcccgacactttgggaggcagaggcaggtggatcccttgaggtcaggagtttgagatcagcctggctaacatggtgaaaccctgtgtctaccaaaaatacaaaaattagccaggtgtggtg

SEQ ID NO: 12935 - DNA, 216 bp, Homo sapiens
gcgcgcctgcaggtcgccactagtggatccaaagaattcggttcgagggaaattgacatgcttttaaattatctacaaatattagcccttaaaagattatatagcagtatatattatgttaaccaatccatgtgcagctgatggactttgtgattcagtggataataagcattagtttttcctgctttgatcttatgtatatccatacagaaaaac

SEQ ID NO: 12936 - DNA, 400 bp, Homo sapiens
  misc_feature 14, 15, 43, 45: n = A,T,C or G
tgtgcgcctgcagnngccccactagtggatccaaagaattcgntncgagaggaaaattaatatcacagcctaaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagt

SEQ ID NO: 12937 - DNA, 338 bp, Homo sapiens
  misc_feature 12, 112, 113, 325: n = A,T,C or G
ttcggcacgagntaccaccaactgcctttctttgttcctagttactgtaacaaatatttgatgatagaggtttattaattttgtttatccagaccattaattttatttgttnntgttctatgtaatcaaataaaatttgagtaacatgtaatggaaaggattaatgcgtggttatttggaccagaaaaaagtgccatagaagaccaataactgtttagttgaggctagtctggaacctttcattagagcaatatttggttattgcacttcatttttatttactaagaaatgcaatttggggaatttttaatctgttatgctttgnttatcaaccttga

SEQ ID NO: 12938 - DNA, 141 bp, Homo sapiens
ttcggcacgagcatgtgcctgtaatcccagctgcttgggaggctgaagtgggaggattgcttgagcctgggaggtcaaagcagcagtgagccgagattgcaccactgcactccattcgcctgggcaacagagtgagaccct

SEQ ID NO: 12939 - DNA, 328 bp, Homo sapiens
  misc_feature 14: n = A,T,C or G
gtttgttctgctgnttgtttcctttcctttcctgttggcctttgtaggaatttgtacttgtgggatggagagttgcttgtttagagaacctcctctgggcattgatgttggattttggttattttgtagattaaaaagaaagagaacaaaagtggagccaaatgtgcatgtagtatagccacagattttgctcgaagtacagttttcgtagacttagactaaagaactggaagaggaaccatgtagcttacacggcctcttccagtcttctcattttgaagatgagaaaactgaggccgtggggaagtggcttgcccaaagatatatg

SEQ ID NO: 12940 - DNA, 351 bp, Homo sapiens
aggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccacta

SEQ ID NO: 12941 - DNA, 362 bp, Homo sapiens
  misc_feature 333: n = A,T,C or G
tggaagtttatcagttgtaacaaatgtaccactctagtgggggatgtccgataatggagaaggctaagtgtgttgggaggggggaagggagtatatgggaaattcctgtaacaggctcaattttgctgtgaacataaacttctctaaaaagtagcctattttaaaaaaatcgaacaggaaattagaaaatattttgaactgaatgaaaatgaaaccatattttcaagtgactaagatgcaacttatagcaatgcttagacaggaatttgtagcactacatgtctatgttagaagagaagaatggtctcaaattaataactcatcagagattgncataatcatcttcaaaatgtctgaacatc

SEQ ID NO: 12942 - DNA, 316 bp, Homo sapiens
  misc_feature 296: n = A,T,C or G
acttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcncccaggagacaagacagaga

SEQ ID NO: 12943 - DNA, 303 bp, Homo sapiens
atgatcagcactaagtcctgcattcctgttaaagccacttgggtcataagaagggagtaaaaaatgaagtctgactagaattctattgcagaggccaagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatg

SEQ ID NO: 12944 - DNA, 170 bp, Homo sapiens
atcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatg

SEQ ID NO: 12945 - DNA, 335 bp, Homo sapiens
  misc_feature 296, 319: n = A,T,C or G
gtacagtgtgtgcccacgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccntccttcagcctgtggccaccttntggggcacgatggggg

SEQ ID NO: 12946 - DNA, 339 bp, Homo sapiens
gcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgt

SEQ ID NO: 12947 - DNA, 101 bp, Homo sapiens
  misc_feature 7, 8, 17, 23, 33, 42, 47, 48, 52, 55, 60, 62, 66, 70, 71,74, 84, 86, 87, 96, 99, 100: n = A,T,C or G
ccccccnncccttcttntccccnaaagaataanataagaatngctanngagnaancgacnanggtnttannagntatatgtatntnncaaaccaantanna

SEQ ID NO: 12948 - DNA, 337 bp, Homo sapiens
tgtcacgatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatacttt

SEQ ID NO: 12949 - DNA, 336 bp, Homo sapiens
  misc_feature 266, 273, 324, 328, 336: n = A,T,C or G
ccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtntcaaggngttttgacgggcatcccacccgccctacgacaaagaaaaaagcgggatggngggntcctgctn

SEQ ID NO: 12950 - DNA, 340 bp, Homo sapiens
  misc_feature 149: n = A,T,C or G
gtttaaaattacttatgcagataccgtaatttacagtataaatgtaataatcaaacaggaggataacgacctgaagaaaatgagaaaataaaatatttcttaattgtaatcataataaaacaattgcagattgctaagtagctgttggnggtacaagtttgatatttagcttgagaatgggtatggaatgaatcaaatacttcatcactaaagaattcttgttatttaatatcaaataatgaaacagcagtcacttctagttcattaccatttcttgtagctgttgtttttagatatagtccactgcattcttataagttctaaattttatgtttattat

SEQ ID NO: 12951 - DNA, 337 bp, Homo sapiens
  misc_feature 329: n = A,T,C or G
cattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgctttgtcttgcacagagctcctggtctgtgccaccttggccangctggctg

SEQ ID NO: 12952 - DNA, 117 bp, Homo sapiens
gaaaaaccctataaatgtgaagtatgtggtaaagccttccgtcagagttcatatcttaaaatccatctgaaagcacatagtgtacatgaaaccttttaagtgtgaagagtgtggggc

SEQ ID NO: 12953 - DNA, 337 bp, Homo sapiens
  misc_feature 97: n = A,T,C or G
ctcaggggctctagggactgccaggctgtttcagccaggaaggccaaaatcaagagtgagatgtagaaagttgtaaaatagaaaaagtggagttggngaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaat

SEQ ID NO: 12954 - DNA, 339 bp, Homo sapiens
  misc_feature 2, 157, 199: n = A,T,C or G
gngacacttcgagagctggtagttagtagcatgttgagccaggcctgggtctgtgtctcttttctctttctccttagtcttctcatagcattaactaatctattgggttcattattggaattaacctggtgctggatattttcaaattgtatctagngcagctgattttaacaataactactgtgttcctggcaatagngtgttctgattagaaatgaccaatattatactaagaaaagatacgactttattttctggtagatagaaataaatagctatatccatgtactgtagtttttcttcaacatcaatgttcattgtaatgttactgatcatgca

SEQ ID NO: 12955 - DNA, 327 bp, Homo sapiens
cctgaactgggcagactgcaaaataaaatctcggggttctatttatttattgtcttcctgtaagaccttcgggtcaaggcagaggcaggaaactaactggtgtgagtcaaatgccccctgagtgactgcccccagcccaggccagaagacctcccttcaggtgtttgacacagaatagcaccattgtgtaggacacacacagttcctgcgcccggagtacttctagagcggccgcgggcccatcgattttccacccggggtggggtaccagggtaaagtgtacccaatttcgcccctataggtgaggtccgtattacaatttcactg

SEQ ID NO: 12956 - DNA, 338 bp, Homo sapiens
caaaatgacatttaatttattaacttatgttttctccctacctgttcccccttttatgtttcctcttaggagatatttgtcccattcctttcttaatttcccccgatcttaaagccattgtcctgaaaatagagtttgaagagaaaacaatttctctggaactaaataaaaggtctcacaagaaatatagacaagcatgttgtctcatatttccctatttccctgtgtatgtagcagatacctttacaccctggtcatcactgacaaagagaaggcagagaaactgaagcagtccctgccccccggtttggcagtgaaggaactgaaatgaaccagac

SEQ ID NO: 12957 - DNA, 338 bp, Homo sapiens
aacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacat

SEQ ID NO: 12958 - DNA, 220 bp, Homo sapiens
  misc_feature 137, 213: n = A,T,C or G
cggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttntacagaaacaagttgaagtacctggctttcctccgcaagcggatgaacaccaacccttgccgaggccccctaccanttgcgga

SEQ ID NO: 12959 - DNA, 257 bp, Homo sapiens
  misc_feature 219, 248: n = A,T,C or G
gcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtncaggggatgtgaatactggtaaatagctngtgctcaga

SEQ ID NO: 12960 - DNA, 271 bp, Homo sapiens
  misc_feature 228, 256: n = A,T,C or G
cagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattccgtgttcgccggggnggcccgaaaacgcccagttcctaagggngcaacttacggcaag

SEQ ID NO: 12961 - DNA, 100 bp, Homo sapiens
  misc_feature 17, 45, 57, 59: n = A,T,C or G
gggacaaaacctggttntcgcgcgcctgcagtcgacactagtggntccaaagaattntncacgagggaagatgctggaggagaaaccctggggaaggctg

SEQ ID NO: 12962 - DNA, 140 bp, Homo sapiens
cttatcttaagatcgatcactgggttcagtgaagttccagttaaaacctaaacaagatttattgttagataggcctaatttaaaatgtgtataaaagtgcaaagaggctgtggaagaacaagatttgttttttttttctt

SEQ ID NO: 12963 - DNA, 194 bp, Homo sapiens
  misc_feature 185, 191: n = A,T,C or G
gaacttgacactccaaactcctgtcatggcacggaagctaggagtgctgctggacccttcctaaacctgtcactcaagaggacttcagctctgctgttgggctggtgtgtggacagaaggaatggaaagccaaattaatttagtccagatttctaggtttgggtttttctaaaaataaaagattncatttnctt

SEQ ID NO: 12964 - DNA, 201 bp, Homo sapiens
  misc_feature 157: n = A,T,C or G
gaaaaaaagagtaaccatctcaaaacttagtggatttaaacagcaacagcttattatttctcatgattttgtggattgactgggcagttctgccccacatgatggcagctggggtgactcatgcggcagcatttcagctggacacatggctgggccnttctctccatatggggttgcatcctcctctgtctcctgaaggat

SEQ ID NO: 12965 - DNA, 308 bp, Homo sapiens
  misc_feature 4, 10: n = A,T,C or G
ctcnaagaanttcggcacgggcaaaaaaggcctcaaccaagattctgagtaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtg

SEQ ID NO: 12966 - DNA, 106 bp, Homo sapiens
  misc_feature 19: n = A,T,C or G
attttttccttttggcccnatagctaggtttctggttcccccacagtaggtgttttcacataagattagggtccttttggaaagaatagttgcagtgtttatagga

SEQ ID NO: 12967 - DNA, 346 bp, Homo sapiens
cgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagcttgttgcagcatccagttcatcttaagaatgtcaacgattagtcatgcaataaatgttctggttttaaaaatt

SEQ ID NO: 12968 - DNA, 344 bp, Homo sapiens
  misc_feature 16, 160: n = A,T,C or G
acgacacgtactacgntgtagctcacttccactatgtcctatcaataggagctgtatttgccatcataggaggcttcattcactgatttcccctattctcaggctacaccctagaccaaacctacgccaaaatccatttcactatcatattcatcggcgnaaatctaactttcttcccacaacactttctcggcctatccggaatgccccgacgttactcggactaccccgatgcatacaccacatgaaacatcctatcatctgcaggctcattcatttctctaacagcagtaatattaataattttcatgatttgagaagccttcgcttcgaagcgaaaagtc

SEQ ID NO: 12969 - DNA, 245 bp, Homo sapiens
  misc_feature 46: n = A,T,C or G
actagattccacagggaaatgggcagactgaaccagtccaggtggngaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagaga

SEQ ID NO: 12970 - DNA, 340 bp, Homo sapiens
  misc_feature 21, 35, 108, 112, 141, 255: n = A,T,C or G
tagtttcgagttttttcttanttccacctttctancccatagaacactcttttttatcttccctgaaccatattgatgagataaatagggctgggggctgggccccgntggncactcaacagagtatttcccttggccganatggaagttttgtcccaatagatgagctgctgagtatcaacaaggtgacatttttctgctgcccatttgtgccctggagacgggggtaccctgaaggcagaggccagctgccgnaagacagcaatgacagtccacctgccgacctgattcctgcatcatggaataaccacatggctaccttctatcctctgttcccaaa

SEQ ID NO: 12971 - DNA, 255 bp, Homo sapiens
  misc_feature 169, 214, 228, 236: n = A,T,C or G
cagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctggncgggggaggagctgctactgctgctaccgaggcttgggggccctnatccttcactcagntgggaaanaaaccgctccttgccccga

SEQ ID NO: 12972 - DNA, 339 bp, Homo sapiens
ctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtgagggtgggtggggtgatgggttgcagacggaggtcaggtcttcctctttcctgagactggatctgttcaaacagcaaacgcccacagatggcccagaggtggtgg

SEQ ID NO: 12973 - DNA, 254 bp, Homo sapiens
  misc_feature 243, 249: n = A,T,C or G
ctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagnggcttnccttt

SEQ ID NO: 12974 - DNA, 339 bp, Homo sapiens
  misc_feature 26, 49, 51, 71, 162, 175, 197, 247, 264, 277, 281, 297, 312: n = A,T,C or G
gcagcgtctggggtttccgttgcagncctcggaaccaggacctcggcgngncctagcgagttatggcgacnaaggccgtgtgcgtgctgaagggcgacggcccagtgcagggcttcatcaatttcgagcagaaggaaagtaatggaccagtgaaggtgtggngaagcattaaagnactgactgaaggcctgcatggnttccatgttcatgagtttggagataatacagcaggctgaccagtgcaggncctcacttttaatcctntatccagaaaacncggnggcccaaaggatgaanagaggcatgttgganactttgggcaattgggcctgctgacaa

SEQ ID NO: 12975 - DNA, 138 bp, Homo sapiens
tttgaatttgtatgctcctgataacatagcttccaaacacagaaaacaaagattggcagaaccataaggagaaagacatacactcactgtcataatgggagttttgaagcatacctgtcagttattgatagattataa

SEQ ID NO: 12976 - DNA, 334 bp, Homo sapiens
aattgtaagaaattatttgaatatataaactttagacaaaatgaaggaaaagtgttttcttatccttaaaccctgctgttcatttgaaactgtatagtatatttggttgagttggtcactgagttccgtgatgtttgacctacagaaaaatttgaggattcagaaattggcggggtgtggcggatcacctgaggtcaggagttcgagaccaacctggccaacacggtgaaaccccgtctctgctaaaaatgcaaaaattagccgggcatagtggcaggcgcctgtagtcccagctacttgggaggctaaggtaggagaatcccttgaacccgag

SEQ ID NO: 12977 - DNA, 359 bp, Homo sapiens
  misc_feature 2, 6, 73, 85, 127, 338: n = A,T,C or G
gnagcnccctctttctttctagactggattatgctcacatgctcccttgccctgacatttttgtaaattctgngccctttgctgnagctacacttcagattaaaggaggagaaagaatgtgctgagngttttcctccctttgcctctacctggccctcatcccaacagcccagcaaggggagagagaaagagaattcttttctatagaacgagtgggggcggggatgggtagggatttatccaatctaagccctaaccccacttagtgaccctcagggctttcttccattccttcttactgccctgccctctgccttggaagaggctttgggaatagntcatagggaagggacaacatg

SEQ ID NO: 12978 - DNA, 198 bp, Homo sapiens
gaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaac

SEQ ID NO: 12979 - DNA, 338 bp, Homo sapiens
  misc_feature 323: n = A,T,C or G
cattccccttgagctgaacgggaagctcacttggcatggcctttccgtgtcccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccaccttcgacgctggggctggcattgccctcaacgaccactttgtcaagctcatttcctggtatgacaacgaatttggctacagcaacaggggggggnggacctcatggccca

SEQ ID NO: 12980 - DNA, 261 bp, Homo sapiens
caaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtccttcctgtgctatttgtacaaataaacctgaggcaggaaaaaaaaaaaaaaaaaaaaa

SEQ ID NO: 12981 - DNA, 339 bp, Homo sapiens
  misc_feature 206, 258: n = A,T,C or G
ggcgagcggggctttggacgccggtggagacgcaggcgagatggagcctcgctctgtcgccaagactggagttcagcggcacgatctcggctcactgcaagctccacctccgaggttcacgccattctcctgcctcagcctcccaagtagctgggactacaggcgcctgccaccatgcccggctaatttttttttgtatttttagnagaggcgggtttcaccgtgttagccaggatgttctctatctcctgacctcgngatctgcccgccttgacctcccaaagtgctgggactacaggcgtgagccaccgcgcccggcctcgggggatttttaacaaa

SEQ ID NO: 12982 - DNA, 353 bp, Homo sapiens
gcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattatt

SEQ ID NO: 12983 - DNA, 354 bp, Homo sapiens
  misc_feature 2: n = A,T,C or G
gnttcaccatgttacccacgctgggcccaaactcctgagctcaagcgaaccacctgactcgttctcaaagtgttaagattagaggtgtgacccaccttgcccagcctgtttttttaaaggtgtcacctttttgagcatctcacatactaggcaattcgcatatcccatttagtcctcacagaggcgtcatgagggatgtgtcattgtaacaatttataatgagggaatagacttagaagggttaagttactggtgcccaaggtcatagagacataatcaaattggtctgaattccaatgtatgactaccacacctgtaacctgctatgctactctgtctccctaaaacccataa

SEQ ID NO: 12984 - DNA, 333 bp, Homo sapiens
  misc_feature 148, 285, 321: n = A,T,C or G
caaatgagaatatccccgagttggcggctgagctggtgcagctgggcttcattagtgaggctgaccagagccggttgacttctctgctagaagagaccttgaacaagttcaattttgccaggaacagtaccctcaactcagccgctgncaccgtctcctcttagagctcactcgggccaggccctgatctgcgctgtggctgtccctggacgtgctgcagccctcctgtcccttccccccagtcagtattaccctgtgaagccccttccctcctttattattcangagggctgggggggctccctggttctgagcatcatnctttcccctccc

SEQ ID NO: 12985 - DNA, 117 bp, Homo sapiens
  misc_feature 18, 49, 90, 116: n = A,T,C or G
gccaaattcttcagcagnagagctgaggagaagattaagaagtgttggnggggcctgtgtcctggtggcttgaagccacatggagggagnttcattaaatgctaactactttactnc

SEQ ID NO: 12986 - DNA, 185 bp, Homo sapiens
  misc_feature 15, 111, 129: n = A,T,C or G
tttttcactctaagncatgtatgtttctctttgattatttgcatgttatgtttaataagctactagcaaaataaaacatagcaaatggcatcactgtgtttgacttcttgngaaatttctgtactttgnatataaaatacataaaacaatagattagaaatcaaaaaaaaaaaaaaaaaaaaaaa

SEQ ID NO: 12987 - DNA, 258 bp, Homo sapiens
  misc_feature 73, 134: n = A,T,C or G
ctgacctcaagtgatccacctgcctcggcctcccaaagtgctaggataacaggtgtgagccaccgtgcccggntgaagatttttcttaattgcaataaatattcagcattttttctaatgaaaatgaattttgnttaccagtaaaagtatgcattttaaaagactttcagatttatgctttttacgtgaagctgctaaactaaaagtaaatggaagaaaccaagtctagtaggttttttctttttttttgtgggggtg

SEQ ID NO: 12988 - DNA, 278 bp, Homo sapiens
  misc_feature 51, 211, 223: n = A,T,C or G
ggtgcgggggcttatgcttgtcatcttagcacttttggaggccgaggcagntggatcacttaaggccaggaatttgagactagcctggccaacatggtgaaaccctgtctctactaaaaatacaaacaattagctgggtgtgggggtaccgcacctgtagtcccagctgcttgggaggctgaggcaagagaatcgcttgaacctgggaggnggacgttgcagngagccgagatcatgccgctgactccagcctgggtgacagaatgagactctgtctc

SEQ ID NO: 12989 - DNA, 100 bp, Homo sapiens
  misc_feature 5, 6, 33, 35, 36, 42, 46, 48, 55, 59, 69, 81, 87, 91, 94, 97: n = A,T,C or G
aaggnnaggctcgttgggggaaaaaacccgccntnncgggcncccngnaaacccncacnaggggacccnaaaaaccggaanaaaccncccnagnaancca

SEQ ID NO: 12990 - DNA, 323 bp, Homo sapiens
accactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaaga

SEQ ID NO: 12991 - DNA, 292 bp, Homo sapiens
  misc_feature 2, 30, 77, 99, 118, 231: n = A,T,C or G
gngcttcaaaaacctcagcatgattagtgntggagcgaaacaaggaagcaaagcaaatacagtttttgaaattctcntctgttgcttgaactattttgnaataattaaactttgatgntgagaaatcacaactttattgtacacttcattgcaacttgaaattcatggtcttaaagtgagatttgaatttctattgagcgcctttaaaaaagtaataccaaaccataaagntaaaatctatgtatattgagtcatatctaaaaccacgtataaacataaattgtatttcctg

SEQ ID NO: 12992 - DNA, 339 bp, Homo sapiens
  misc_feature 5, 49, 191, 245, 337: n = A,T,C or G
ctcgngccgcacaagttctattgagtgctattcagaataggaacaaggntctaatagaaaaagatggcaatttgaagtagctataaaattagactaatctacattgcttttctcctgcagagtctaataccttttatgctttgataattagcagtttgtctacttggccactaggaatgaaactacatggnaataggcttaacaggtgtaatagcccacttactcctgaatctttaagcatttgngcatttgaaaaatgcttttcgcgatcttcctgctgggattacaggcatgagccactgtgcctgacctcccatatgtaaaagtgtctaaaggntt

SEQ ID NO: 12993 - DNA, 313 bp, Homo sapiens
  misc_feature 30, 117, 207, 227, 288, 291: n = A,T,C or G
gacaggatgaatggatcaaaggagtgaggntgctaaagaacatccttttccctctcattctacccttttcctctccccgattccttgtagagctgctgaacttcttagaggggcagntctacctcctctgtccctcggcagaaagacgtttccacacctcttaggggatgcgcattaaacttcttttgcccccttcttgtccccttngaggggcacttaagatgganaaatcagttgtggtttcagggaatcatggacacctgtatttattgctaggagaagcctganggnggggggagatgatcatgtgtgc

SEQ ID NO: 12994 - DNA, 344 bp, Homo sapiens
  misc_feature 128, 142, 324: n = A,T,C or G
cccaacccaaaccatgagaatttgcgacaggggaggaaaaaagaaccaaaacttccaaggccctgctttttttcttaaaagtactttaaaaaggaaatttggttgtattttttatttacattttatantttttgtacatatnggcagggtcagccatttttaatgatctcgggtgaccaaaccagccttcggagcgttctctgtcctacttctgactttacttgtggggtgaccatgttcattataatctcaaaggagaaaaaaaaccttgtaaaaaaagcaaaaatgacaacagaaaaacaatcttattccgagcattccagnaacttttttggggtatgtac

SEQ ID NO: 12995 - DNA, 205 bp, Homo sapiens
  misc_feature 133: n = A,T,C or G
atccaaacaacaaagcataatatttcgcccactaagccaatcactttattgactcctagccgcagacctcctcattctaacctgaatcggaggacaaccagtaagctacccttttaccatcattggacaagtngcatccgtactatacttcacaacaatcctaatcctaataccaactatctccctaattgaaaacaaaatactc

SEQ ID NO: 12996 - DNA, 339 bp, Homo sapiens
  misc_feature 7, 86, 144, 263, 317, 321: n = A,T,C or G
tccaggngaacggaggcactgtggccgagaagctggactgggcccgcgagaggcttgagcacgcaggtacctgtgaaccaagtgtntgggcaggatgagatgatcgacgtcatcggggtgaccaagggcaaaggctacaaaggngtcaccagtcgttggcacaccaagaagctgccccgcaagacccaccgaggcctgcgcaaggtggcctgtattggggcatggcatcctgctcgtgtagccttctctgtggcacgcgctgngcagaaaggctaccatcaccgcactgagatcaacaagaagatttataagattgnccanggctacccttatcaagga

SEQ ID NO: 12997 - DNA, 112 bp, Homo sapiens
  misc_feature 5, 9, 11, 82: n = A,T,C or G
ctcgngccncngttttaagttattagtttttaaaatcagtactttttaatggaaacaacttgaccaaaaatttgtcacaganttttgagacccattaaaaaagttaaatggg

SEQ ID NO: 12998 - DNA, 339 bp, Homo sapiens
  misc_feature 42: n = A,T,C or G
aagaaaagaaggaacaatggtcgtgccaaaaagggccgcggncacgtgcagcctattcgctgctctaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgcttgccccacgtcccccaccaaagcccat

SEQ ID NO: 12999 - DNA, 339 bp, Homo sapiens
  misc_feature 52, 72, 139, 306, 309: n = A,T,C or G
ctgaggatttttggtccgcacgctcctgctcctgactcaccgctgttcgctntcgccgaggaacaagtcggncaggaagcccgcgcgcaacagccatggcttttaaggataccggaaaaacacccgtggagccggaggnggcaattcaccgaattcgaatcaccctaacaagccgcaacgtaaaatccttggaaaaggtgtgtgcttgacttgataagaggcgcaaaagaaaagaatctcaaagtgaaaggaccagttcgaatgcctaccaagactttgagaatcactacaagaaaaactccttgnggnggaaggttctaagacgtgggatcgtttcca

SEQ ID NO: 13000 - DNA, 339 bp, Homo sapiens
catttttttggaaacctctgcgccatgagagccaagtggaggaagaagcgaatgcgcaggctgaagcgcaaaagaagaaagatgaggcaggaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgt

SEQ ID NO: 13001 - DNA, 339 bp, Homo sapiens
  misc_feature 226, 265: n = A,T,C or G
cttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggcttgacatctgcaggccgaaagagccgnggccttggaaagggccacaagttccaccacactattggnggctctcgccgggcagcttggagaaggcgcaatactctccagctccaccgttaccgctaatataagtaaagttt

SEQ ID NO: 13002 - DNA, 336 bp, Homo sapiens
  misc_feature 109, 163, 179: n = A,T,C or G
aaacagcttttgactcagctttgatttatcctcatttgatttggccagaaagtaggtaatatgcattgattggcttctgattccaattcagtatagcaaggtgctaggntttttcctttccccacctgtctcttagcctggggaattaaatgagaagccttanaatgggtggcccttgngacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgc

SEQ ID NO: 13003 - DNA, 480 bp, Homo sapiens
  misc_feature 29, 40, 143, 367, 427, 475: n = A,T,C or G
cgggcgcttgcggccgacactagtggatncaaagaatttngcacgagctgaagcgaattggcaccaaagcagcagcatgtattgccgcagttctagcttcaccttcacgatgtttcccttggtcaaaagcgcactaaatcgtntccaagttcgaagcattcagcaaacaatggcaaggcggagccgccagaaacgtacacctgattttcatgacaaatacggtaatgctgtattagctagtggagccacttttctgtattgttacatggacatatgtagcaacacaagtcggaatagaatggaacctgtcccctgttggcagagttaccccaaaggaatggaggaatcagtaatcatcccagctggngtaataatgaattgtttaaaaaacagctcataattgatgccaaattaaagcacttgtgtncccattaagatatggcatttttgaagaaaataaaggacattttgaaanccttc

SEQ ID NO: 13004 - DNA, 191 bp, Homo sapiens
  misc_feature 3, 5, 180: n = A,T,C or G
tgnangtcccccactagtggatccaaagaattttttcgagccccacccaggggctgagtgtggaccccccgggcggcccaggggaccccgccccgacccaggggctgtggacgatgtacaggcaacagagctacgcactcctttccttttggaagcaagaagaaaatacgtgaaaacggnaattaaagatt

SEQ ID NO: 13005 - DNA, 334 bp, Homo sapiens
  misc_feature 10, 196, 207, 214, 286: n = A,T,C or G
acgagctcgngccgaattcggcccgagaaaaaagagaaacgccaacaaaaatcagcagatgttgaagacaggggtctcgggggtgggctccggcacccacatcctggagtcaggactttcctcagtgactgtgtgtagggggggtttcaggggctgaaccccacctccctcccaccttcctcccaccttacctgtngcacccactgngaaagtnggaatatgtggtctccctggcctcagggctctgactctgccagggtggggctctctaacccacaggtgttgncttgcctggcccatgtgcccactgtctcttccacttggcctgggtttg

SEQ ID NO: 13006 - DNA, 355 bp, Homo sapiens
  misc_feature 17, 22, 44, 46, 47, 72, 98, 105, 186, 187, 219, 241: n = A,T,C or G
aactggggcgcttgagnacccncactagtggatccaaagaattntnntcgagattcaatgaagtagcattcnaatatgtaagttattttatatattgnccgtctnttaaaattggactttgcttcttgaaaaaagtttgtcaaatcaccaaaccatatgactgtccattcattgtagcctatgttnnctattattaagaaataattcatactgagagtnaaagaaaaagaatgtattttgngtgcaaaggatgaatgtattaaaaactttttatttgtaacaattttttaaaaaaactaaatggaaattgctttcccatgtacttgtatataaataaacatttcctgttgcccac

SEQ ID NO: 13007 - DNA, 164 bp, Homo sapiens
  misc_feature 18, 67, 94: n = A,T,C or G
gtcaaatgccccctgagngactgcccccagcccaggccagaagacctcccttcaggtgccgggcgcnggaactgtgtgtgtcctacacaatggngctattctgtgtcaaacacctctgtattttttaaaacatcaattgatattaaaaatgaaaagattattgg

SEQ ID NO: 13008 - DNA, 423 bp, Homo sapiens
  misc_feature 37, 74, 96, 127: n = A,T,C or G
gatgacacaggaagagctggtgtccaacctggggacnattgccagatcggggtcaaaggccttcctggatgctntgcagaaccaggctgaggccancagcaagatcatcggccagtttggagtgggnttctactcagctttcatggtggctgacagagtggaggtctattcccgctcggcagccccggggagcctgggttaccagtggctttcagatggttctggagtgtttgaaatcgccgaagcttcgggagttagaaccgggacaaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggacc

SEQ ID NO: 13009 - DNA, 108 bp, Homo sapiens
  misc_feature 3, 11, 15, 31, 41, 43, 56, 62, 68, 78: n = A,T,C or G
cgngcgcttgnaggnccgacactagtggatncaaagaattntncacgagcggaggngcaggncctggngcttgatggncgaggccatctcctgggccgcctggcggcc

SEQ ID NO: 13010 - DNA, 332 bp, Homo sapiens
  misc_feature 248: n = A,T,C or G
cttcctcattctgtataaggcagctttcagtttgcttagaaggcaacattggaatgttagagttcatcagaaacacagaattttaaactgtgagttccactgaatacattttaatttctgtaggaagaatcaaaatacctatttaaagatggcaatatataataatcattttaaaagtatttgattcaacctgataattttccagaaatgaaaaaaaaaatcagctctaaaaccaaagctgattttanaaaatttgaaaatgtaaatcagccctatccataatatagtttctctaaaactttaaagagttgttttaaaataatataactatt

SEQ ID NO: 13011 - DNA, 292 bp, Homo sapiens
ttcagttttatggtgttttctgtgttttgttctccctgaccactttggttgatgtattttttccatgcgtctccacatctgttggggtagacgtgttgattgattgcattgcccaccagcaccctacaatcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttac

SEQ ID NO: 13012 - DNA, 117 bp, Homo sapiens
  misc_feature 112, 116: n = A,T,C or G
tccctgcagttttgtggcttcaagtgtgggtggacagtcctaatggggatctccagctccttcctgtgggctgccacagacagctacccccagaagggtcaatgttgggagnggtng

SEQ ID NO: 13013 - DNA, 334 bp, Homo sapiens
gttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttgggagtctg

SEQ ID NO: 13014 - DNA, 233 bp, Homo sapiens
  misc_feature 145: n = A,T,C or G
taattccaaagatgactacaaccatgtccatgctcagattcaaacagttttccatatcacttttgggtggtaagatgatttacagttttttttttaattggcagcaccactaaccattccttacattcttttttgtatggggggntttctttttatttaacccgcagccgacatcggagtttcttggtttgttttgtttacagagctgttgcatgacttatgtaccatcccta

SEQ ID NO: 13015 - DNA, 317 bp, Homo sapiens
  misc_feature 2, 8, 92, 166, 274: n = A,T,C or G
gngctggngccattgccccatgtgaagtcactgtgccagcccagaacactggtctcgggcccgagaagacctcctttttccaggctttaggnatcaccactaaaatctccaggggcaccattgaaatcctgagtgatgtgcagctgatcaagactggagacaaagngggagccagcgaagccacgctgctgaacatgctcaacatctcccccttctcctttgggctggtcatccagcaggtgttcgacaatggcagcatctacaaccctgaagngcttgatatcacagaggaaactctgcattctcgcttcctggag

SEQ ID NO: 13016 - DNA, 325 bp, Homo sapiens
ctctgttttagcagaggggaaactgaggcgcagagcagtgaagtaacttgcccaaggtcacacagctgggaaggaacaaagccaggcctggttccagagtgcatctacccacggacagggcctagaggaaagcccgtgagactgacacccctgacttccccaagggcacgctgcaatagatgccctgacaacaatgtgatcaccgcccctgtttacagatgcagaggccaaagttcagcaagccgagggacctgccttgggtctcccagctggtaagtggtggagctgggattcgaacccaggtccaacagactcctcagtccat

SEQ ID NO: 13017 - DNA, 389 bp, Homo sapiens
  misc_feature 4, 17, 41, 68: n = A,T,C or G
tggngctcgcgcgcccncaggtcgacactagtggatccaanttaattcagcacgagcaggttagttgngctagctaactcaacgatttttttaatagaaaaacttagggacagaaacttatagataacccttatgccaaaaattgctgtcagctttgaatttttattaactattatgccagagcagagcaataactaatttatgaacagattagatcacaaaatgtttataagttatttgtttcaaatttggaggatgtttcttcatagagagatgttgtaaatggtgattaggattttagttgacctaaaataagcatctatgaatctcataacttagctaatatctaatatggtctctcacccttttttgagggaaaataaaacttg

SEQ ID NO: 13018 - DNA, 314 bp, Homo sapiens
  misc_feature 12: n = A,T,C or G
catgtgcagatnatatggaacaacctctgtcctaagctttctgtcaaacactttattggcctgatggtggatgaggagagatgcataggattcaaagcttacacagaggattcatatgctgaatttaagttgcaagacctcaaggttatgcagaggaaaaccaggagtccctcgtgtaagctgtggatagaatggtctgttctggactcattcgggtatacactaatgaaaacctagctgctgtcaataggagttggtagggaagtataggctcacggactgtggaatttcattctgaactcctttggctctca

SEQ ID NO: 13019 - DNA, 190 bp, Homo sapiens
gttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaac

SEQ ID NO: 13020 - DNA, 180 bp, Homo sapiens
  misc_feature 2, 96, 125: n = A,T,C or G
tncggcacgaggcagcattagccatcgtgccctgctgaggggctggctgccttgagtggcctgatcgccacagcccttcttggaagaaaggcgtcntgtgtttcaggttccacgcgagtcacctntttcgtcttaatgttcaccggccacagctttggaataaaccatcctgggaaagtt

SEQ ID NO: 13021 - DNA, 400 bp, Homo sapiens
  misc_feature 2, 70: n = A,T,C or G
gngcgcctgcaggaaccccactagtggatccaaagaattcggttcgagcccaaaacgaagaagaactgantggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcatttt

SEQ ID NO: 13022 - DNA, 256 bp, Homo sapiens
  misc_feature 151, 161, 218, 234, 246: n = A,T,C or G
gagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgnggcgacttanagttggcggatattcggaactgtgaatgtacatagcgttgagttaaaccccttgtgngtgagacaggacgcancgggcccctggnggcctggggg

SEQ ID NO: 13023 - DNA, 102 bp, Homo sapiens
  misc_feature 20: n = A,T,C or G
ctgaggtgggaagattaccnggggccaggagttcaaggctgcagtacatgaggatcacacctgtgaatagccactgcaccactccagcagcctgggcaagac

SEQ ID NO: 13024 - DNA, 287 bp, Homo sapiens
  misc_feature 159: n = A,T,C or G
ccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagnctctcaagtcccgaggctacgtgaaggaacagtttgcctggagacatttctactggtaccttaccaatgagggtatccagtatctccgtgattaccttcatctgcccccggagattgtgcctgccacc

SEQ ID NO: 13025 - DNA, 331 bp, Homo sapiens
  misc_feature 321: n = A,T,C or G
cttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagngtgcacactg

SEQ ID NO: 13026 - DNA, 139 bp, Homo sapiens
  misc_feature 13, 112: n = A,T,C or G
ctgcgtttgcatntttataatcaaaagcttaatatattcccatcttttttagttaaccctttcttgactctgagtgctgtgaatttctttactgatttctctattctccggngagaaacaattaaatgtgatttaacgt

SEQ ID NO: 13027 - DNA, 294 bp, Homo sapiens
  misc_feature 263: n = A,T,C or G
catctttttatgggtggagcagagagtcaatccctgcagccagccatctctgcagttctctcagtgcaggcagttcttcctctcaggctgaagatcaaggagatgctttgtacatgaacagatgctgagtatctgttatcattgtattggttagtgtcagtgtatcatttagtatttgtatcactgtaccatttagtgttgtatatcactcagtcatttaatattggttatcaccatacagtttaatatttgtatcatttggntcattgtatcgtttagtatttctattataac

SEQ ID NO: 13028 - DNA, 339 bp, Homo sapiens
  misc_feature 177, 255: n = A,T,C or G
gggcaatttacttaatctctccatgctttagctgctttgtctataaaattgggatggtacaaatacttttgggagtcatttaattctcaaaggatgaaatgacttgatatacgtaaaagcatttagaactgtgcctaacacatgataggcattactgggtttagtgatgatgctggngctgatgatgccaatgatgcagatgatgcagcaaattacaaattaaataacaacatattaagccattatgtattcagnttttcttattcttaaatcttaaggcaaagctttgatcagaagaataattgaataattactgtattagatctacttttagaaaag

SEQ ID NO: 13029 - DNA, 347 bp, Homo sapiens
ctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaacccagcttcggaagctaccctaggatctcgtcaataaactgctaagaagccatcaactggcctaaagaaagagttcacttgaagaacgcaattgctttaaagaaagaaaaattagtttcctatttaagtcttaaaaaaaagcaaaccatgtcctg

SEQ ID NO: 13030 - DNA, 136 bp, Homo sapiens
tgaaaactgtactgtatacctatataaatatacacacacttacatgtatgtattttgatagatattacatggactaaattttgtcaatttcatgtaatttaccctttgcaataaaaatgattcattaaatatataa

SEQ ID NO: 13031 - DNA, 230 bp, Homo sapiens
  misc_feature 137, 165: n = A,T,C or G
gccaagcgggaagccctgggtgcggtgggcatgatgggtcctccaggacctcctgggccccctgggtacccaggcaagcagggcccccatgggcaccctggccctcggggcgttcctggcatcgtgggagccgtggntcagatcggcaacacggggcccaagggnaaaacgtggaagagaagggtgatccagggagaagtgggaacgggggccaccccgggaatgccttg

SEQ ID NO: 13032 - DNA, 338 bp, Homo sapiens
  misc_feature 17, 272: n = A,T,C or G
cgcgcgcctgcaggtcnacactagtggatccaaagaattcggtacgagggagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccanaaccagccctttgtcttctcccttggcacaggccaggtcatcaagggctgggaccaggggctgctg

SEQ ID NO: 13033 - DNA, 400 bp, Homo sapiens
  misc_feature 17, 35, 160: n = A,T,C or G
gcgcgcctgcaggtcgncactagtggatccaaagnaattcggctcgagcttgagtacatgttatttagaagttatataaaaagtcaatggaaaagaaaacatttgtcacgcacttaaaagttcattttaaaggaaagttaagcttatcagagtgaccagnggtgtttagaagagtgagattccaagcctgtctttagacagaggaggagtaacaggaacctgagctttcagactctcttgctttcttcctggtaatttaggagcttttaggctatgagtgaataacaggggtggaaatttaggagcttttaggctatgaatgaataacacgggtggaaataaaatgacactacaggtgggattgtatctcagagttaaggcagaggactttaagtctcta

SEQ ID NO: 13034 - DNA, 109 bp, Homo sapiens
  misc_feature 17, 42: n = A,T,C or G
gcgcgcctgcaggtcgncactagtggatccaaagaattcggntcgagtttcaccttccgccatgattgtgaggccttcccagccacgtggaactgtaagtccaataaac

SEQ ID NO: 13035 - DNA, 344 bp, Homo sapiens
  misc_feature 176, 321: n = A,T,C or G
gtgctgagctcgtaagtgtacaatatgactgtctagtaaattcttaattatttgtcgactctttatcgaagaaaaaagtaagtaggggaaaagataaaggagcatccagccggtggcaaaggaacaagccgtgtagctctgcttctcacccactctcagctagcttgggccacggntgcctgaagtgacaccaaacaggaaccccactgggaggactgtacgggccacacccatggacgtgatctgtctatgaaacaggtcttctcagtgcttcggggtgaattttgacttctcctgagccatcctcagagcacagctggnggggaacttcacccgtctggtca

SEQ ID NO: 13036 - DNA, 335 bp, Homo sapiens
ctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacac

SEQ ID NO: 13037 - DNA, 326 bp, Homo sapiens
  misc_feature 303: n = A,T,C or G
gatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggccctttggagaaacatggatgatgatcgcctttcaagacgtgctgatgatgatcggtttcccagacggggtgatgactcaagacctggtccttggagaccattagtcaagccaggtggatggagagagaaagaaaaagccangagaggagagcttggggtccacc

SEQ ID NO: 13038 - DNA, 196 bp, Homo sapiens
ctcgtgccgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactga

SEQ ID NO: 13039 - DNA, 305 bp, Homo sapiens
  misc_feature 2, 138: n = A,T,C or G
gngacatcgtctttaaaccctgcgtggcaatccctgacgcaccgccgtgatgcccagggaagacagggcgacctggaagtccaactacttccttaagatcatccaactattggatgattatccgaaatgtttcattgngggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatg

SEQ ID NO: 13040 - DNA, 185 bp, Homo sapiens
  misc_feature 16, 43: n = A,T,C or G
gcgcgcctgcaggtcnacactagtggatccaaagaattcggtncgaggccacgggaggggggccccgggacattgcgcagaaaggaggctgcaggggctcggcctgcggccgccggtcccacgaggcactgcggcccagggtctggtgcggagaggccccacagtggacttggtgacgcttgtat

SEQ ID NO: 13041 - DNA, 229 bp, Homo sapiens
ccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagcccctggactcatcatcaataaacactgttacagc

SEQ ID NO: 13042 - DNA, 186 bp, Homo sapiens
  misc_feature 128: n = A,T,C or G
gaaggagcctgggtgagaaacaccatccaaagctggggcaaagatgattaccttcagcatgattacaatgtattaccttcagtatgattacagaagtcctacttgacaatcacatatagaagaacggngctattcagtaagttctctttcctttcccttggagggaagacagcagagtcatcagtt

SEQ ID NO: 13043 - DNA, 145 bp, Homo sapiens
ggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 13044 - DNA, 335 bp, Homo sapiens
  misc_feature 6, 162, 165: n = A,T,C or G
tgcagncgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggnggngacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactgg

SEQ ID NO: 13045 - DNA, 339 bp, Homo sapiens
gccgccatggccgcctccccggcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatgga

SEQ ID NO: 13046 - DNA, 127 bp, Homo sapiens
gtccttgaagccaagggtttaaaaacaaaacaaaaacaaaaaaaaccacaagtaggttattcaagttgtttgcaacatacattttgtaatgaaatgtgagaaattaataaagaatttttttcacatg

SEQ ID NO: 13047 - DNA, 336 bp, Homo sapiens
  misc_feature 96: n = A,T,C or G
catcagcctcacaaagtgacacagtataagaagggcaaggattctttgtatgcccagggaaggaggcgctatgatcggaagcagagtggctatggngggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgaggg

SEQ ID NO: 13048 - DNA, 263 bp, Homo sapiens
  misc_feature 6, 7, 28, 29: n = A,T,C or G
ccctgnntgcgacactagtggatccaannaattcgccacgagtctctagcatccttgtttggtctcccctgttgtctttggatttccctagagagaatgttagcctctgacacctatagctgcagctaactgcaaaaataaaaccaaattcctagcaaggtaaacataaaacctcacaataaagactaatttacttccaatccttttacaaatacactatgtctgtctcttaataaaaaaaattataaggcatactaaaagac

SEQ ID NO: 13049 - DNA, 335 bp, Homo sapiens
  misc_feature 275: n = A,T,C or G
gttttctacactgctggtgtggcaatagatttttaaatgttacttttaaaaagaaaaatggagatttgggagcagtaatggaggatcctcagcaccactggaaaataggctgggttaggggggtgcctgaaagttccagcctccaaagcaaacttatagtatggctgtgtgttgccgtgggatgctggtggcagctttgtcagacacagatcatgggtcttgctccagaatccattgggctgccaagtgactctttgaagatctgtctgtaatgngtgagtcttgtccatctgctcttgactctgagctggctaggtgactgttggttattcctg

SEQ ID NO: 13050 - DNA, 181 bp, Homo sapiens
gccaaataagtgtatttcattgttttttgctaaaaccgtttgatagtctgggtagttggtactggaaaaaacgctgctgtgacgtgaggagtactatggcacctgtttatgtagaagttagggggatattgcaatatcattcaagattggtcagaaatagggcaagaaggaggcaggatat

SEQ ID NO: 13051 - DNA, 230 bp, Homo sapiens
gatgaactcaagccctgtggccacagttctgggagccttcaaccctggctcatgctgccatagtctccacggtgcccttcacagagggcttggtagtggcagaatggccatgcccaggtgtgtgttgagaccattgacaactgctcgtgtacaggcaccccacagccccagagcatggggcacagcaggcatgcgagtgagaggatgaaggggaataaagtcagtacaac

SEQ ID NO: 13052 - DNA, 339 bp, Homo sapiens
  misc_feature 122: n = A,T,C or G
gccaaatcccgtactccttgccaccggcttcctagagcagcgtagacagctggtaaactgaagagcacaactatattcttatgaaggaatttgtacctttggggtattattttgtggcccgngaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaaggga

SEQ ID NO: 13053 - DNA, 206 bp, Homo sapiens
  misc_feature 196: n = A,T,C or G
ttcggcacgaggggcgacgtgctcacccttttggagtcagagcgagaagcccggaggttgcgctgagcttggctgctcgctgggtcttggatgtcgggttcgaccacttggccgatgggaatggtctgtcacaatctgctcctttttttttgtccgccacacgtaactgagatgctcctttaaataaagcgtttgngtttcaagtt

SEQ ID NO: 13054 - DNA, 253 bp, Homo sapiens
tagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccct

SEQ ID NO: 13055 - DNA, 335 bp, Homo sapiens
  misc_feature 182, 213: n = A,T,C or G
ctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggngcagatgattaaacagtcttccctatttggngcaatgaagtatagcagataaaatgggggaggggtaaattatcaccttcaagaaaattacatgtttttatatatatttggaattgttaaattggttttgctgaaacatttcacccttgagat

SEQ ID NO: 13056 - DNA, 339 bp, Homo sapiens
ggcaaccctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcac

SEQ ID NO: 13057 - DNA, 339 bp, Homo sapiens
  misc_feature 18, 218: n = A,T,C or G
ctacacgccgccgcttgngctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggnggaacgtgtgatcaccattatgcagaatccacgccagtacaagatcccagactggttcttgaacagacagaaggatgtaaaggatggaaaatacagccaggtcctagccaatggtctggac

SEQ ID NO: 13058 - DNA, 342 bp, Homo sapiens
gtttattagcttaaactagtaatagagagcaaactggcttttcttcttagcataggtttttggaaacttgaactcaaaaatcagtaaattcaaaaggagttatagtttcagagtatttggcataatatatttgaaaagaatattcccttcacttatctttgtttgcattagacttgtgttaattatgtgattcctctccatagcctcaataataaagagatctcaagttggaatgtatagttctatttttcataagtatcatttaaaaaccgatttataaaccctatgacttatgaaatatttgtgaacaaaacacccaatgccactggaataattcaaatg

SEQ ID NO: 13059 - DNA, 389 bp, Homo sapiens
ctgtgggattgactttttagggcaaatgagaattttgaagataattactctcctcctccattcctgtatctttaacaactgccaggtcccagtgacactttgataaaatgtttttagagccagtcacttgtgttgctgtggtctgccttgtcgtagaggcacatcatttttgcacatcagtattaacagttcaaacaccctgaaatgctaatagcactagtaagcttttaattccatggaatttattgcttgctgtgtttccatgaatttataacgctttgattcttaagagccccatttaatcagttttgcctggcaccgaacataataaacaacttgctggtgaaaaagtgccactcggggaggctgctaacaaggaagttaaatgc

SEQ ID NO: 13060 - DNA, 345 bp, Homo sapiens
gttaatttccccatgatggttgtcctgttatatgagggaatagccttgttttggaaagccagtactgaagtattaggagtaatgtattactgactcacaaatggttttggaaaaaagtgagtgcatatgtatgtctgtgtgtgttggtgtgtgtatttagagatgataggaaaaatgtggtaaaatactaatcattagagaatctgggagaaaaaatatacaagactttgctattgaaacttttctgtaagtttaaaattatttcacaattaaaaattgaaaagatttgacagttgagagaaggttgggcaaatgtcttaaaatgaaactacttcataaaagatc

SEQ ID NO: 13061 - DNA, 344 bp, Homo sapiens
aaataatgaaatgaaggcagaaataaagatgttctttgaacccaatgagaacaaagacacaacataccaaaatctctgggacacattcaaagcagtgtgtagagggaaattcatagcactaaatgcccacaagagaaagcaggaaagatctaaaattgacaccctaacatcacaattaaaagaactagagaagcaagggcaaccacattcaaaagctagcagaaggcaagaaataactaagatcattgcagaactgaaggaaatagagacacaaaaaacccttcaaaaaatcaatgaatccaggagctggtttttcgaaaagatcagcaaaattgatagaccgc

SEQ ID NO: 13062 - DNA, 400 bp, Homo sapiens
  misc_feature 2, 34, 41: n = A,T,C or G
gngcgcctgcaggtcccactagtggatccaaagnaattcgnttcgagggagaactggagaaagaaagagaaaatcgttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaag

SEQ ID NO: 13063 - DNA, 226 bp, Homo sapiens
  misc_feature 2, 42: n = A,T,C or G
gngcgcctgcaggtcccactagtggatccaaagaattcggtncgaggtcagcctgggcaacatagggagacctgcacctctacaaaaaattaagaaattagccagtcatggtagagcctgcctatggtcccagctacttgagaggctgaggtagtgaggtacgaggtcgaggctgcagtaagccatgatcacgccactgcactccagcctgggcaacagagcaaga

SEQ ID NO: 13064 - DNA, 342 bp, Homo sapiens
  misc_feature 3, 6: n = A,T,C or G
ttnggnacgagattaagttcgagataccttgaagtcctgattaacctttataggacacacattgacattataggatcttcttctgacacttacctgtttaaaaaaggggtcatgaaattaatagggcaaaaggttagttaataaaatctcagcaatatagtcataagggctgctttctcttgctgagcagtgaccattgccatgaatgaggctagctttacacaccgtatctcatgaatccttatagtcatccttctttgtcagtgttgactatcctcatgttacagcggaagaaactaggatttggagaagttaaaacacttttctgaagttatccagttg

SEQ ID NO: 13065 - DNA, 334 bp, Homo sapiens
tcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatggg

SEQ ID NO: 13066 - DNA, 335 bp, Homo sapiens
gcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttatttttt

SEQ ID NO: 13067 - DNA, 333 bp, Homo sapiens
ttcatattcaaatatcatccatttcccaataattttcccctgtccatgattgaatgcatttagttattttgtccttttgctcccttaatcctttttgttttctcagtttttgtctgtcatgacattgaaatttttgaagcgaaaaggctaattctatagactgttaatcaattttggtttatctgtttcttcctgacttaagtcaggctatgaaatacaacctatagccaaagatggctgaaacaaaagaaaaaataattaaaaagatgaaatataaccctggactattacactcagtgcaatttgtcccactattggtgttgttgactattt

SEQ ID NO: 13068 - DNA, 310 bp, Homo sapiens
  misc_feature 55: n = A,T,C or G
gttctctcctggccactcttcctgctgcctctgactactcagccttgttttcggngtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaat

SEQ ID NO: 13069 - DNA, 309 bp, Homo sapiens
cgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaac

SEQ ID NO: 13070 - DNA, 120 bp, Homo sapiens
gtagtcccagctactcgggaggctgagacaggagaatgtcatgaacccaggaggcagagcttgcagtgagccaagatcacaccaccacactccagcctgggtgacagagcgagactccgt

SEQ ID NO: 13071 - DNA, 350 bp, Homo sapiens
gtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagta

SEQ ID NO: 13072 - DNA, 334 bp, Homo sapiens
gggcaatttacttaatctctccatgctttagctgctttgtctataaaattgggatggtacaaatacttttgggagtcatttaattctcaaaggatgaaatgacttgatatacgtaaaagcatttagaactgtgcctaacacatgataggcattactgggtttagtgatgatgctggtgctgatgatgccaatgatgcagatgatgcagcaaattacaaattaaataacaacatattaagccattatgtattcagtttttcttattcttaaatcttaaggcaaagctttgatcagaagaataattgaataattactgtattagatctacttttag

SEQ ID NO: 13073 - DNA, 336 bp, Homo sapiens
agaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataat

SEQ ID NO: 13074 - DNA, 185 bp, Homo sapiens
ctcgtgccgggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgt

SEQ ID NO: 13075 - DNA, 360 bp, Homo sapiens
  misc_feature 153, 178: n = A,T,C or G
acagcagctctcacacacacacaccacagcacacacaatagctcacacacacgccgcagcacacacacaaaccacagcacacaaacactacagcacacacacacacagcacatacaccacagcgcacacacacaacagcacatacacgacagngcacatgcacaacagcacacacacnatagttcacacacacagcatacacacaccagtgcacacacataccacagcgcacacacacaccacacacagcacatacacaccacagcatacacacaatagctcacacacaccagtccatacacacacacgccacagcacacacaccacagtccacacaaacagcacatacacagcagctca

SEQ ID NO: 13076 - DNA, 340 bp, Homo sapiens
ctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagca

SEQ ID NO: 13077 - DNA, 339 bp, Homo sapiens
  misc_feature 17: n = A,T,C or G
ctcgtgccgctgaaggnggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggcttgtacccgctgcggaagtacgcggtcaaggcctgaggggcgcattgtcaataaagcacagc

SEQ ID NO: 13078 - DNA, 184 bp, Homo sapiens
gacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttg

SEQ ID NO: 13079 - DNA, 125 bp, Homo sapiens
  misc_feature 13: n = A,T,C or G
attcatgttaagnctccaacacttttaccttccaatgcttttgtactattagtgctagtgtcaacacagaagagcaaataatatcttagtattactacattacagtttttatttcatgcttcccc

SEQ ID NO: 13080 - DNA, 333 bp, Homo sapiens
gccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgc

SEQ ID NO: 13081 - DNA, 358 bp, Homo sapiens
  misc_feature 16: n = A,T,C or G
ctgagcttcaaaatcngggcacgccacaggcaagagaaacaaaggagcactcagtggggaggagcaggaatgggagctgatgccgaggagtattggagtctgtgcaggccctcacagggaggagatggagttaccactccctcacatgacaggaagcacaacctcaagccaaggaaagctggggaacaggaacaaagccacctgcataaaggcgggaccctggaagggctgccccacacgttcgtgctggttgttcactgtacgagagcgcctgattgggggcaggggtggagctggaatccagcctgcatgccagtgccatgccgagcacctggagcagggccatgtgatcctgctg

SEQ ID NO: 13082 - DNA, 329 bp, Homo sapiens
  misc_feature 17, 131: n = A,T,C or G
cttctggagaccaaggngcttctggtcctgctggtccttctggccctagaggtcctcctggccccgtcggtccctctggcaaagatggtgctaatggaatccctggccccattgggcctcctggtccccgnggacgatcaggcgaaaccggccctgctggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggat

SEQ ID NO: 13083 - DNA, 361 bp, Homo sapiens
  misc_feature 321, 328, 359: n = A,T,C or G
gccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcanaaaactnaaacaaaaaaagacttactaagaaatatgtnca

SEQ ID NO: 13084 - DNA, 129 bp, Homo sapiens
  misc_feature 13, 72, 94, 113: n = A,T,C or G
agagaaacaatcncagaacagtccgggaaatagtgctgaaggaacataatacacactcacaacgacgtgttnggaatgatgatagatcaccgantaaaactctgtgactaagncgggaaagggagccat

SEQ ID NO: 13085 - DNA, 330 bp, Homo sapiens
agtctgattgccaaagcatatggatccttcttaaatctgaaatatcatctgccaatgctcaaggccatgttcagaatgtctgacatctttgaattcctacaagaagcccaattatgcaaagatagttttgagaaaattagtataatatgtactacccagttatgcttctctgtggtctctccttttccctatattaaattaggtcactagaagctgcaacatattaatatttgtatatttactgtaatacattgtagaatttcattagagtagctcttcaacaacagatggtctacttttacaatccaaattttttcattgcaaatgttt

SEQ ID NO: 13086 - DNA, 276 bp, Homo sapiens
  misc_feature 43: n = A,T,C or G
gtggaggatgagctgagggaaatagcctcagagcctgtggcangagcactacttctacacggctgacttcaagaccatcaaccagataggcaagaagttgcagaagaagatctgtgtggaggaagacccgtgtgcctgcgagtccctggtgaaattccaagccaaagtggaggggcttgctgcaggccctgaccaggaaactggaagctgtgagtaagcggcttggccatcctggagaacacagttgtctaaggctgcctgtcaccactgtggcct

SEQ ID NO: 13087 - DNA, 186 bp, Homo sapiens
  misc_feature 162, 171, 185: n = A,T,C or G
attacatgtcgtttacaatagttacttaaaaataaccacctaaggccagcatttttataattatttacctttttacctccttctgggaaataaagttttcagaaacataaatgcagcagagatagagattttctgagtgattggcccttggtgccatagaancccaaaggntaataggactattng

SEQ ID NO: 13088 - DNA, 318 bp, Homo sapiens
  misc_feature 224: n = A,T,C or G
cttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttganaaataaaaaagccttaggtaaataagtcattctccctagcagagccacttgggtctcctgcatggaagccgtcacacttgggcaggtgttcagt

SEQ ID NO: 13089 - DNA, 308 bp, Homo sapiens
gggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatc

SEQ ID NO: 13090 - DNA, 236 bp, Homo sapiens
  misc_feature 228: n = A,T,C or G
tgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggccngggacctg

SEQ ID NO: 13091 - DNA, 345 bp, Homo sapiens
  misc_feature 212, 288, 330: n = A,T,C or G
cgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggcttgtctgcaatgaaccacgcctggtgaaggagcctgggtganaaacacccatccaaagctggggcaaagatgattaccttcagcatgattacaatgtatttaccttcagtatgatacnagaagtcctacttgacaatcacatatagaaagaacggggctntttcagtaagttctt

SEQ ID NO: 13092 - DNA, 330 bp, Homo sapiens
  misc_feature 72, 134, 164, 165, 167, 224, 243, 281, 305: n = A,T,C or G
ggggagaacacccccagtgatccctgaggttgtttattacatatatatctttcagaaaatttttagcctgcntccccaatatatggcactttatttataaattacattcatatgctagtctaatatatattggnattactaaatttacacaaaaatataaattnnanaagatgaaataaagcatttaaaacgttattagaagttcaaaaaacccttcatattgnctctcattctaaaaatatnggaattgaaaccaactgattaaacatctcattactttntacatctttaacattgtgccaggnaggaatgtaaaggctggggttcaga

SEQ ID NO: 13093 - DNA, 183 bp, Homo sapiens
  misc_feature 181: n = A,T,C or G
gccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagccccagcgcnta

SEQ ID NO: 13094 - DNA, 301 bp, Homo sapiens
ggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 13095 - DNA, 154 bp, Homo sapiens
  misc_feature 20, 66, 139, 150, 154: n = A,T,C or G
ctgagccgacattgccggcntcttggcgattcggcccgacgagctccgctttcgctacagcatggnggcctactggaggacaggctggactcagctacatccgatactcccagatctgtgcaaaaagcagtggagagangcccttggaanacan

SEQ ID NO: 13096 - DNA, 347 bp, Homo sapiens
  misc_feature 2, 41, 290, 345: n = A,T,C or G
gngcgcctgcaggtcccactagtggatccaaagaattcgtntcgagccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggnggaagtcaccattgcagatgcttaagtcaactattttaataaattgatgaccagntg

SEQ ID NO: 13097 - DNA, 293 bp, Homo sapiens
  misc_feature 134, 269, 286: n = A,T,C or G
ctggcttcactgctcaggtgattatcctgaaccatccaggccaaataagcgccggctatgcccctgtattggattgccacacggctcacattgcatgcaagtttgctgagctgaaggaaaagattgatcgccgntctggtaaaaagctggaagatggccctaaattcttgaagtctggtgatgctgccattgttgatatggttcctggcaagcccatgtgtgttgagagcttctcagactatccacctttgggtcgctttgctgttcgngatatgagacagacagntgcgggg

SEQ ID NO: 13098 - DNA, 188 bp, Homo sapiens
  misc_feature 187: n = A,T,C or G
agttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccggng

SEQ ID NO: 13099 - DNA, 177 bp, Homo sapiens
cccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactcc

SEQ ID NO: 13100 - DNA, 268 bp, Homo sapiens
  misc_feature 209, 236, 246: n = A,T,C or G
catctggcgctcccatggctcttgcaacatctccccttcgtttttgagggggtcatgccgggggagccaccagcccctcactgggttcggaggagagtcaggaagggccaagcacgacaaagcagaaacatcggatttggggaacgcgtgtcaatcccttgtgccgcagggctgggcgggagagactgttctgttccttgggtaactgngttgctgaaagactacctcgttcttgncttgatgggncacccggggcaactgcctgggg

SEQ ID NO: 13101 - DNA, 257 bp, Homo sapiens
  misc_feature 153, 156: n = A,T,C or G
ctggagcctcggtggccatgcttcttgccccttgggcctccccccagcccctcctccccttcctgcacccgtacccccgtggtctttgaataaagtctgagtgggtacagggtgcaggaaggggaggaggggctgggctcgggccaaattcgnaangagctcagtctcctgctttcaaatttaggacagagccgctaaggacaaaacaatccctcccgtgctttatgatggcagcaggggctggggagcctctgagg

SEQ ID NO: 13102 - DNA, 316 bp, Homo sapiens
  misc_feature 254: n = A,T,C or G
cgcgcgcctgcaggtcgacactagtggatccaaagaattcggtacgaggcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgngggcaggtgtttgagaagtcccccctgcgggtgaagaacttcgggatctggctgcgctatga

SEQ ID NO: 13103 - DNA, 360 bp, Homo sapiens
  misc_feature 12, 15, 40, 162, 206: n = A,T,C or G
gcgcctgcaggncgncactagtggatccaaagaattcggntcgaggctatccccaccggcgtcaaagtatttagctgactcgccacactccacggaagcaatatgaaatgatctgctgcagtgctctgagccctaggattcatctttcttttcaccgtaggnggcctgactggcattgtattagcaaactcatcactagacatcgnactacacgacacgtactacgttgtagcccacttccactatgtcctatcaataggagctgtatttgccatcataggaggcttcattcactgatttcccctattctcaggctacaccctagaccaaacctacgccaaaatccatttcactatcata

SEQ ID NO: 13104 - DNA, 183 bp, Homo sapiens
  misc_feature 15, 170: n = A,T,C or G
gaagattatgccacntgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtncccgtgcgcagag

SEQ ID NO: 13105 - DNA, 334 bp, Homo sapiens
  misc_feature 91, 137, 186: n = A,T,C or G
gggggtttaaggacatgtgtacaagtttttgatactcctgccctcaggaggtgggacttccttcctctttccttaatgacttacttccagngaagtgatgggatggcacttctaaaattagattacaaaaggactgngactcaggtggctctcttgccctccctcttgaatccctcactctggggnggacagtggccatgccatgaggacactcagctggtggagaggctgtatggggaggagccaagtctggaaacatactctcccccagtcaggccttgaggtgactgcagcctcctgagagaccctcagccggagccacccagctaagccg

SEQ ID NO: 13106 - DNA, 165 bp, Homo sapiens
tataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaatta

SEQ ID NO: 13107 - DNA, 336 bp, Homo sapiens
gctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgg

SEQ ID NO: 13108 - DNA, 353 bp, Homo sapiens
  misc_feature 2, 17, 44: n = A,T,C or G
gngcgcctgcaggtcgncactagtggatccaaagaattcggttngagccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcg

SEQ ID NO: 13109 - DNA, 336 bp, Homo sapiens
  misc_feature 309: n = A,T,C or G
gcagaaatttctaggaaaagggtggcaactcttaagtcatcaggttgttgctgtggaaaggggcggtaacttctgggtgttgccatggcaatggtaaactgacatgacatattggtgggtatgtcttatcgaaaatggcttccacccctgacctacctgttttagttagtcctcaatttggtcaggtgtctgagccctgcctcctacctctccaggacatgggcagtagcctggctgggcactttaaaaaggacagttgtatccaagcctttgatttttttctgtcaattttaacattttctgtctcanaaatatctatttcatctagattttcac

SEQ ID NO: 13110 - DNA, 267 bp, Homo sapiens
ggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccag

SEQ ID NO: 13111 - DNA, 327 bp, Homo sapiens
  misc_feature 319: n = A,T,C or G
tgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgntctgtttc

SEQ ID NO: 13112 - DNA, 317 bp, Homo sapiens
  misc_feature 287: n = A,T,C or G
gtgctatatgacttcttttaaaaatcgaaagtaatgcttaaactgttatgtttatcatcctgaaaccaatgtgaagaaccactttaatatttgtgtagttatcactttatagtatagatagtagtttataaagcactttggcatgcctcagcctatttgatgcttctttttgttttaattttaatttttgggggtatataataggtgtatatacttaaagggtagatgaaatgttttgatactggcatgcactgcctaataatcacatcatgtaaaatggggttggngcttctttttgaagctgtcaaactgtacat

SEQ ID NO: 13113 - DNA, 261 bp, Homo sapiens
gaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatgg

SEQ ID NO: 13114 - DNA, 336 bp, Homo sapiens
cttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggggggatcaagctggcggagagctggccactctagatggcacattt

SEQ ID NO: 13115 - DNA, 336 bp, Homo sapiens
ggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtgg

SEQ ID NO: 13116 - DNA, 339 bp, Homo sapiens
ctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttggg

SEQ ID NO: 13117 - DNA, 127 bp, Homo sapiens
gaaccgcaaagccatcgtggaaagagctgcccaactggccatcagagtcaccaaccccaatgccaggctgcgcagtgaagaaaatgagtaggcagctcatgtgcacgttttctgtttaaataaatgt

SEQ ID NO: 13118 - DNA, 321 bp, Homo sapiens
tcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcggccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaag

SEQ ID NO: 13119 - DNA, 328 bp, Homo sapiens
ttcggcacgagactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttc

SEQ ID NO: 13120 - DNA, 332 bp, Homo sapiens
  misc_feature 16, 168: n = A,T,C or G
atcatatgaatgctgngttgactatgaaatgtgcaggggattattcagtaatgactttcttctgtcgtccttcactaatcctgtcaatcgggaatgcctttagattaggaaagaatcccactggaaggagctgtctttctcatttacagttgggcttccccaggggcnggagaagcagggtcactgtagctcacttattggccagtgaagacagccgccatatctaagcaatgactctattcctcatcactggtctgggttcctgatccaaacctacaacagtcaatggacatttctaccttggggttccacgagctaagggtctgaaaaat

SEQ ID NO: 13121 - DNA, 282 bp, Homo sapiens
  misc_feature 137, 171, 176, 255, 260, 277: n = A,T,C or G
gccaacaggtaggtcctgctggacaggacctgaaaattaagagatttttttttttaagcagggaaatttaaaaatctattacctcaagaattttcagtcgatatgtcaatgtactgttccttctcagtaagtacagngtcacatgctgctggcggtaaaagcaacccaagngtcanatcacacaaattttagggacaagtctttcaaaagacggacaccttgggatattttggagtctaatttccgacttttcgnaatgncccaatgaccttttgtnggggt

SEQ ID NO: 13122 - DNA, 128 bp, Homo sapiens
ctggagctgggcacagccataagacaggactggaccagatgctcctgtaaacatccaggggtgtgccagggcccaccctcacaactgcttgttcaggtatcgtgatgggccactcggtccaaaatcag

SEQ ID NO: 13123 - DNA, 338 bp, Homo sapiens
  misc_feature 98: n = A,T,C or G
agaaattggtcggtatggcccaacatagcttctgctctgtcttactgactcaatacctttaggatttgtatcagagtttggatactagtgttagtggnggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccat

SEQ ID NO: 13124 - DNA, 339 bp, Homo sapiens
  misc_feature 177, 222, 224, 231: n = A,T,C or G
ctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgnggattcccctgcattgtttgttttatataacatttgatatttggngnagcttgnatatgaacataattttctttagaggtagtcactgttctctccagtatgacccaggtttcttgactctgagtaatgcaccttctataactatctaaatttctattgaag

SEQ ID NO: 13125 - DNA, 337 bp, Homo sapiens
  misc_feature 6, 8: n = A,T,C or G
cttctntntgctcatgtctgactgcactgatgtgctgactcgtgctggccatgctgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtg

SEQ ID NO: 13126 - DNA, 333 bp, Homo sapiens
cacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacgga

SEQ ID NO: 13127 - DNA, 339 bp, Homo sapiens
ctcctgttcacatgtgcaatcttctgtgtgtttcaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtatta

SEQ ID NO: 13128 - DNA, 341 bp, Homo sapiens
  misc_feature 229: n = A,T,C or G
attagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggnggcaagtccatctatggggagaaatttgaagatgagaacttcatcctaaagcatacgggtcctggcatcttgtccatggcaaatgctggacccaacacaaatggttcccagt

SEQ ID NO: 13129 - DNA, 134 bp, Homo sapiens
gaactttttgcatcatgttaatatcaggagcctgccagaactctttggaaaagtattcttcttgtgaatcagagttacaaggtggagaattccactctcagaaacataaaagacctgaaggctgtgccactcct

SEQ ID NO: 13130 - DNA, 129 bp, Homo sapiens
ggtgtgtgcctataatcccagctactcaggaggctgaggcaagagaatcgcttgaacccaggatggggaggtttcagtgagccgagatcgcaccactgtactccagcctgggcacagagcgggactctg

SEQ ID NO: 13131 - DNA, 266 bp, Homo sapiens
ttcggcacgagcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcaagtgccccagtgaagacagaagcgagagaataaagttccctgtaggtcctctg

SEQ ID NO: 13132 - DNA, 334 bp, Homo sapiens
  misc_feature 7, 8, 166, 259: n = A,T,C or G
tgaagannctggggtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgnggccacatggtgtcagatgaatatgagcagctgtcctctgaagccctggaggctgcccgaatttgtgccaataagtacatggtaaaaagttgnggcaaagatggcttccatatccgggtgcggctccaccccttccacgtcatccgcatcaacaagatgttgtcctgt

SEQ ID NO: 13133 - DNA, 320 bp, Homo sapiens
gagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatg

SEQ ID NO: 13134 - DNA, 178 bp, Homo sapiens
  misc_feature 176: n = A,T,C or G
gtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacgganga

SEQ ID NO: 13135 - DNA, 397 bp, Homo sapiens
  misc_feature 41, 43, 62: n = A,T,C or G
gcgcgcctgcaggtccacactagtggatccaaagaattcgntncgagatcaagaggttcatnagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatggg

SEQ ID NO: 13136 - DNA, 400 bp, Homo sapiens
  misc_feature 21, 37, 40, 60, 64: n = A,T,C or G
attacattactggccactagnggatccaaagaattcnttngagcagaaacatactgggtnaccngtggaaaggaaaatgcaaagagaagacagccattggctctttggaagatgtgagtactgaggtagggcttgagatagactgaaacctggaattggagaaaggaggtccaatggcaagacagttcaggggctgaacacactgcatttggaataacaggagcagagccatggaggacagaaagtgtgagtcacttgcagggatgtatgaaaattacttggcagaaacaagaaagtcatctcagggacagacaagagatgaggacagaggcaacctgccaaagggccctgaatgctaaactgaagacctagacttagaaggaggatctatagatttggg

SEQ ID NO: 13137 - DNA, 389 bp, Homo sapiens
  misc_feature 13, 164, 165, 177: n = A,T,C or G
ctgaaataccgtncagccacaccaaatatgaatttctgttaataacacaaaatatttttttaagaaaaaaagaaaaaaaaaggtagggaaagaagaagggaatgagatttagatttaaaactcattggattaaataggtgaggcttattagtaggatatactgnngaagcaaacagnggcacacacaggcttacagtctttgttttttaaaccagttaccactaatgtattaagccctgcagcagttaccactgacttctcgcacgcataaaatgaaccgggagaagccagtgttgatactgttgtgaaaaggttcaagagctggcttttcagacaactaagaccatttttagcagaataactccttcagaaaggcctggctgaagatc

SEQ ID NO: 13138 - DNA, 387 bp, Homo sapiens
caaacccctttctgcctagggttcctggaagccaaggaaacagaacgaactgttccctgggtgggcgagccactgcagagtacaaagctttcaggccgcctgcctcattagcactaatggctgctcccttccgccctgtgtcgtcaggactgtctatgcctggtctcatcagcacaaggctggggtaaggactgcccttttgtggagatggcaggacatacaggaccctgctgcccctgccttccctcaccccactgcagagctgtttatcacacacgtgtccatctgggaaaggaatgcaggctgaatcagctttgagaggatcgcaaggccccagtgcacaaactgggttggcacaaggcagtggaaaaaagatgaagggggcca

SEQ ID NO: 13139 - DNA, 373 bp, Homo sapiens
  misc_feature 7, 284, 357, 362: n = A,T,C or G
gttaggnctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagncagtactataaaatttctcttttgagttttatacctttgtagcattttagatgacattgtgtttgtactttgntgggnagaggggaaga

SEQ ID NO: 13140 - DNA, 383 bp, Homo sapiens
  misc_feature 9: n = A,T,C or G
gaaaaccgngtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtg

SEQ ID NO: 13141 - DNA, 397 bp, Homo sapiens
  misc_feature 1, 376: n = A,T,C or G
nccaggcccaaccgacagaccctgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttntgtttgaggatttctccaaag

SEQ ID NO: 13142 - DNA, 337 bp, Homo sapiens
ctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtt

SEQ ID NO: 13143 - DNA, 285 bp, Homo sapiens
  misc_feature 2, 76, 78: n = A,T,C or G
cncggcacgaggggctccaagtgtctcgatgtggatgagtgtgagacagaggtgtgtccaggagagaacaagcagngngaaaacaccgagggcggttatcgctgcatctgtgccgagggctacaagcagatggaaggcatctgtgtgaaggagcagatcccaggtgcattccccatcttaactgatttaacccctgaaacaacccgacgctggaagttgggttctcatccccactctacatatgtaaaaatgaagatgcagagagatgaagctacttttcccagg

SEQ ID NO: 13144 - DNA, 400 bp, Homo sapiens
  misc_feature 3, 18, 36, 43: n = A,T,C or G
tgngcgcctgcaggtccncactagtggatccaaagnaattcgnttcgagaatgggtaaaggatctaaatagacagttttccaaagaagaaataaaaatggccagtaggtatatgaaaaagtgcccaacatcacattattagggacgtaccaatcaaaaccatagttggctgctacctcacacttgttataatagatattatcaaaaagtcaaaggataacaagtgttggatgtggagaaagggaacccttatacatcgttgttagaagtgaaaattggtacagccattatggaaagcagtagtggaggtgcctcaaaatattaaaaatagaactaccatatgatctagcaatcctgctactgggtatataaccaaaggaagtgaaatcaatatcttaaag

SEQ ID NO: 13145 - DNA, 229 bp, Homo sapiens
  misc_feature 44: n = A,T,C or G
cgcgcgcctgcaggtccacactagtggatccaaagaattcggtncgagccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtga

SEQ ID NO: 13146 - DNA, 380 bp, Homo sapiens
  misc_feature 7, 15, 41: n = A,T,C or G
accactncactgccncactagtggatccaaagaattcgttncgagcgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgtt

SEQ ID NO: 13147 - DNA, 102 bp, Homo sapiens
  misc_feature 68: n = A,T,C or G
catcacccttatatcatgtacctcagatctctctctctctcctctctctcagttatatagtttcttgncttggacttttttttttcttttctttttcttttt

SEQ ID NO: 13148 - DNA, 365 bp, Homo sapiens
  misc_feature 168: n = A,T,C or G
aaaatgtaggctgggtagggagaaaagcacaaatatcaagagggtgaagggtagtgacacgttgtaagatcaatatacagaaaatcccagtgagggtaaagctttgttaggctagtgatataaaatggagatagctgttaaaataggaaggttttattgagtctatgnccatgagaacaaataaccaaggtagcaccaagaacgagctctttcaaaaagaggagttctggaactctgaaggtcaagatgttaaaagggtcatctaaaaacatattaaaaattgtgagggggctgggcaccggtggcctcacacatataatcccagcactttgggatgtcgaggtgggcagatcatgaggtcaaga

SEQ ID NO: 13149 - DNA, 183 bp, Homo sapiens
  misc_feature 177: n = A,T,C or G
ctcatttactattctgaaaaatccaagagcccttaaaaattgttaattttattgtgcctgtactctataaatggaacaacaaagcctagaggacagtgtatctgtttacggcatgctattggaatattcatgagctgcatgaacttaaaatatttctgaatattttaagcctactgntgaggc

SEQ ID NO: 13150 - DNA, 367 bp, Homo sapiens
gtggatccaaagaattcggcacgagaaactacttaggaatgattgcttcaactatttattaagaggaaagagaacctgttcaatggctgctgtatactaggcactgtgtaaaacgctgggagagtaaagatgaataagacagtgctctcctaaaggagtaccatgtcttgttagggggatgctaatagactaaaggagagcacatttagcttaagcttttctttggatggttttttctgcactcattatgtaccagacactatgtaagttactgggatctaaagatgagtgacactgatcctttaaggaattcagggtctagtgaggatgctgttaatgaatgcttatagtacagtgccacgggtgc

SEQ ID NO: 13151 - DNA, 331 bp, Homo sapiens
  misc_feature 170: n = A,T,C or G
ccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgntgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaat

SEQ ID NO: 13152 - DNA, 334 bp, Homo sapiens
  misc_feature 64: n = A,T,C or G
gcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggcttgtccagaaaacgtaatgaggatgaagattcaccaaataagctatatacttttggttacctatgta

SEQ ID NO: 13153 - DNA, 337 bp, Homo sapiens
cctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcagggggttaccaggtgtacctggaattcctggtgcaaagggtgttgctggtgaaaagggtaacacaggtgctccagggaagcctggtcagatgggaaattca

SEQ ID NO: 13154 - DNA, 333 bp, Homo sapiens
  misc_feature 29: n = A,T,C or G
gttaaagaccaccaggagcacactttccntgctgttggaaaggctgatgccaatcaaaaaccaactttttccctaaaggatgatctgtctttctcctccttttgacaggatgtaacaaaacaaaggagtcttcaatgttatatcatggaaatcaggacagttggcagttcggattgtggcaatcaaaggggtggaaagtgaattctatcttgcaatgaacgaggaaggaaaactctatgcaaagaaagaatgcaatgaagattgtaacttcaaagaactaattctggaaaaccattacaacacatatgcagcagctaaatggacacacaatgg

SEQ ID NO: 13155 - DNA, 354 bp, Homo sapiens
cagtgggaggattgtgatggctctgctctttgaacagtcccgattcccgtgttgcctcctactgaaacattcatcctgttctacaccaagagcggaaaggggatatgatttaaagcataccaacagagtgcattgaggaaagggcaggccgtagtgtcaaatccagaatagaatggaagaatatatcaataaaactgttctattatctgcggggcacacctctgaccaacagtgtttctaagcagtcacctaaacaaagtcagccgaagagccagttcaaccaactatgtgtagctttgctgagtaggttcagagaccctagaactggaagtgaagattctgcatcccccattg

SEQ ID NO: 13156 - DNA, 276 bp, Homo sapiens
  misc_feature 8: n = A,T,C or G
gtggcttnaggccctgtaattcccagcacttttgggaggccgaggcaggcagatcacaaggtcaggagatcgagacccctcctggctaacacggtgaaaccccgtctcttactaaaaatacaaaaaaattagccgggcgtggcagccgtgcgccttgtagtcccagctaccttgggaggctgaggcagaaggatggcatgaacccaggaggtggagcttgcagtgagctgagatcgcaccactgcactccagccttgggtgacagagcgagactgt

SEQ ID NO: 13157 - DNA, 334 bp, Homo sapiens
  misc_feature 54, 106, 115: n = A,T,C or G
gcggggtccgtggtgcgggatcgagattgcgggctatggcgccgaaggtttttngtcagtactgggatatccccgatggcaccgattgccaccgcaaagcctacancaccaccantattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgac

SEQ ID NO: 13158 - DNA, 210 bp, Homo sapiens
ctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgac

SEQ ID NO: 13159 - DNA, 332 bp, Homo sapiens
caaccacgttcctgtcatcaccacactgctacgaggaggtatgtggtttcttcccctctctgtcctctttctccccctcacccccagaatgctcacctcagctggtacctgcaggggcccgtgtagatgccctggaccgagctggtcgcacacccctgcacctggccaagtcaaagctgaatatcctgcaggagggccatgcccagtgcctagaggctgtgcgtctggaggtgaagcaggtgagtaccccttctgtgtggagaccacggcaccaaggcagcacttggacagatgctgccctaaccacagacacacctgcctctggtcccagg

SEQ ID NO: 13160 - DNA, 320 bp, Homo sapiens
  misc_feature 9, 16, 19, 31, 50, 57, 83, 84: n = A,T,C or G
gttgtaaangtgtaanccnagccccctgacnggtcttttgtacactgttnaaaaganccttcgttgttcagtttttcctgacnncttgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatatt

SEQ ID NO: 13161 - DNA, 335 bp, Homo sapiens
  misc_feature 182, 217, 249, 270: n = A,T,C or G
cttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactanaggcttctgactcctgggactttggagcttaccanagatgcagtccctcccaggaacctgttggagnaggcaggacctgctgctttanaagtgcggctgaacccgggcctttgcgtcccctgttttggccagagcaaggatctggcctgggag

SEQ ID NO: 13162 - DNA, 348 bp, Homo sapiens
  misc_feature 24, 161, 174, 176, 301, 334: n = A,T,C or G
cattatgtctagataccaactgtnttttcaccagaaaccaagcaactagatctgctcccctggagcgtcaacaatagtcaaatcagattatccaatattttcaaactttttggcacattttattaattgatttccagtacacgtacttctcatcacagggncctccttctcagngntctccacttgttaacctcagatccaaggctcaatcctctgacttcatatccatttatatttatttctaaagggacctaattaagctcagatttatgactttcaatgcaatgtatacatatttganattatctgaacatacaactttgggctttcatgntcctcaattgaata

SEQ ID NO: 13163 - DNA, 332 bp, Homo sapiens
  misc_feature 246: n = A,T,C or G
gagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggnggacagacgtgtctcaagcccatcacggcctccaaggtcgagtttgccatcagccgggtccagatgaatttcctgcacctgctaag

SEQ ID NO: 13164 - DNA, 292 bp, Homo sapiens
  misc_feature 140: n = A,T,C or G
ttcggcacgagggcggaggtgcaggtcctggtgcttgatggtcgaggccatctcctgggccgcctggcggccatcgtggctaaacaggtactgctgggccggaaggtggtggtcgtacgctgtgaaggcatcaacatttntggcaatttctacagaaacaagttgaagtacctggctttcctccgcaagcggatgaacaccaacccttcccgaggcccctaccacttccgggcccccagccgcattttctggcggaccgtgcgaggtattgcctgccccacaaaaaccaagc

SEQ ID NO: 13165 - DNA, 314 bp, Homo sapiens
tccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaac

SEQ ID NO: 13166 - DNA, 334 bp, Homo sapiens
cagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgagg

SEQ ID NO: 13167 - DNA, 335 bp, Homo sapiens
gttttcccagccagcccctcccccagcgggctacccaggaactgagagttaggacgtgcccttgagtttgggctgtgcccccacttgctgtgtagctttggggagcccctcaacctctcggaaccttgtttttctcatccatcaaatggagagaagtagatttaaggcacaggattgcacccaacagtgtaggcattcttggcgatgttgcaggttcggctccagaccatcggggtaaactgagtcacacagctgttttgggttttccagtgcatttaaaagttagatttagaccgggcacagtggctcatgccctgtaattccagcactttgag

SEQ ID NO: 13168 - DNA, 331 bp, Homo sapiens
ggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctctt

SEQ ID NO: 13169 - DNA, 275 bp, Homo sapiens
  misc_feature 221: n = A,T,C or G
gaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggngtatgttggcaccttagctactttttttttttcctttttgcacaaggggctttc

SEQ ID NO: 13170 - DNA, 330 bp, Homo sapiens
cctgacttgaccagtatgcgtgtaacaaaattgcacctgtaccccatacatctatataaacaatttttttgaaccatgtaatagacatgaagaatggctttgatggcttattagtagagtgaacgtggctgaggaaagaatttctgagactggggatctatcagtagaaacctccaaaactgaaaagcaaagagaataaagactagaaaaagcaggacagcatattcaagaactgtgaaacaactacaaaatataaacatatgcataatatgaatacagaaggagaagaaagtgaaggaaaaattaaaaacttctatttttcttattctt

SEQ ID NO: 13171 - DNA, 361 bp, Homo sapiens
  misc_feature 13, 261: n = A,T,C or G
gtcggggagcagntcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaanactttcctgctccagaagaatataaacactttcagaggatatatcccagcaaaacaaaccgagctgcccgtggagccccacctctgccacccattctcag

SEQ ID NO: 13172 - DNA, 337 bp, Homo sapiens
cctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaaataaaattatgtcaatcattgacaactgcacataaagaaaaatataaatgcatacttccccttgtgaca

SEQ ID NO: 13173 - DNA, 322 bp, Homo sapiens
ttcggcacgagcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacac

SEQ ID NO: 13174 - DNA, 336 bp, Homo sapiens
  misc_feature 314: n = A,T,C or G
ggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctatttttttttttaagaataaaagttaaaatgttttccactagncatttcacttctaacttggaat

SEQ ID NO: 13175 - DNA, 333 bp, Homo sapiens
  misc_feature 22: n = A,T,C or G
gcaaggctgtgagactacctanttgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttattttttttaccaattccaatttca

SEQ ID NO: 13176 - DNA, 329 bp, Homo sapiens
cagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagatttaaaagttgctcatgtagaacatgaagaaaccttatccagccgaagaagggaactaatttcagaagttgaagtctttcatcagcttctatagtgctttgcctggctacatctgcagccatagccctgtggcggaaaacgacacc

SEQ ID NO: 13177 - DNA, 164 bp, Homo sapiens
  misc_feature 3, 7, 23, 43, 44, 92: n = A,T,C or G
ccnaagnacctcggcaccgagcnagtgttggaaggtggtgctnnactgggaggtgtttgggtcctggggggcaagtcactcctgaaatagantgatatcctctctaggatcaggggaagtgagtaagttcttgttctattaattcccataagagctggttgttt

SEQ ID NO: 13178 - DNA, 332 bp, Homo sapiens
  misc_feature 299, 313, 331: n = A,T,C or G
gtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaaaaagctgctcatgatggctggattcgatgactgctacacctcagcccgggggctgcactgccaccctgggcaacnttcgccaaggccanccttttgatgccattttnt

SEQ ID NO: 13179 - DNA, 291 bp, Homo sapiens
  misc_feature 1, 17, 51, 52, 57, 58, 67, 82, 88: n = A,T,C or G
nagtggattccaaaganttcggcacgagggaaatctgaaataagagtactnntgctnntgttggctnaaaactggtgtcccntcactnacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgtttt

SEQ ID NO: 13180 - DNA, 312 bp, Homo sapiens
  misc_feature 205, 228, 254, 281, 297: n = A,T,C or G
gtctggccaacatggcaaaaccccgtctctactaaaagtacaaaaattagccgggcatgatggcgcaagcctgtaattccagctactcaggaggctgaggtgggagaatcgcttgaacccgagaaggggaggttgcagtgagccaagatttcaccactgcaccattgcctggacgacagagcaagactctgtcaaaaaaaaaaanatgggttctgctttgaggctgancagtgaggatgcgagggcagggcccncacttgcagccacagacactcagcttnagctctgctactcggntttgttacttgcagg

SEQ ID NO: 13181 - DNA, 335 bp, Homo sapiens
ggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggc

SEQ ID NO: 13182 - DNA, 337 bp, Homo sapiens
  misc_feature 260, 298: n = A,T,C or G
cacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaaganaaacagacaactctgttctcaggattggggatgggacnggctttcggccaaagcgttttagcctcattcactcaggc

SEQ ID NO: 13183 - DNA, 244 bp, Homo sapiens
gcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaata

SEQ ID NO: 13184 - DNA, 288 bp, Homo sapiens
  misc_feature 264, 279: n = A,T,C or G
attagttaaaagtacttataatgcatgatgttactccactcttcatctgacctgttacctttaaatgaaggaaagcctctctttgttttctattacttcagtcctgtatttcaggatacctgtgtgcctccctcagagaccgtggtgcagtgatttcatgtttttcatacatcaatttttttgggggggggaagatgagaaaaatgtacccaaatctagaagattcataggaaggtaaaggaaaaaaaaagataattggggagngggtttttttttaanacagttttt

SEQ ID NO: 13185 - DNA, 335 bp, Homo sapiens
  misc_feature 266: n = A,T,C or G
gctgcattaacaaatcaccaccagtttggtggcttaaatcaagaaaaatttatttcctcacatttctggagggcagagtccaaaatcaaggtgttggcaaagtcacagtccgtctgggggctttacaggggagtcctttccatgcccatctccttgctcctggtggctgccagaaatgctcgtgttgcttggtttgtgactgaatcaccccaagctctgcctttgtctttacatcctcttctcctctctgtgtgtcttttaatgangacccttgccattgtttcagggttcccccagaaaagcaggatgatcctcaagtccttaactacatctgc

SEQ ID NO: 13186 - DNA, 400 bp, Homo sapiens
  misc_feature 6, 7, 31: n = A,T,C or G
accatnnctgcgacactagtggatccaaagnaattcggacgagggttgttgcagcaagagagaatgaacatattggggaaccaagggatgtctcacaatgggtgaattagagaaggcatttatggggtttagggagctggagttagtcacaggatgatgtatcagtccgttcttatactgctaataagacacacctgagactgggtaatttataaaggaaggaggcttaattgactcacagttccacatggctggggaggcctcgtgatcattgctgaaggtaaatgagcaaagtcatgtcttacatgatggcaggcaaaagagcttgtgtagggaaactcccctttatataatcatcagatctcataagacttattcactttcactagaacagcacggg

SEQ ID NO: 13187 - DNA, 336 bp, Homo sapiens
gcagggcggggcaggggcactgtgtgctttctccgacaggatgagctcgctgcatcggggctgccgagctgcgatgccgccgtcaacctggccggagagaacatcctcaaccctctccgaagatggaatgaaaccttccaaaaagaggttctcggcagccgcctagagaccacccaattgctggctaaagccatcaccaaagccccacaaccccccaaggcctgggtcttagtcacaggtgtagctttactaccagcccagtctgactgcggagtatgaatgaaagacagcccaggaggggacttttgacttttttctccaacctcgtaaccaaat

SEQ ID NO: 13188 - DNA, 123 bp, Homo sapiens
ggatgccccccaccctaccacacattcgaagaacccgtatacataaaatctagacaaaaaaggaaggaatcgaaccccccaaagctggtttcaagccaaccccatggcctccatgactttttc

SEQ ID NO: 13189 - DNA, 332 bp, Homo sapiens
  misc_feature 2: n = A,T,C or G
gngaaagtagtgaaagtggctaaacaaacagcacttagagtaagcatttgccaatacacagcacaaaactttaatgatactaattgtagactgcctctgtgcctttaccttgtaaacaaaaatgagtgggggagagaagggatagtgtgacctcctaaagtgaggaccaacaacccaattagcttctatttatttaatcaatacaaacacactgagagcctctattgtgtctagcactctgctagccccctgctaggggataaggaaacaatacaacccctgctcatttgaaggctggaggcctcacagaaagtttcataaagatggtagct

SEQ ID NO: 13190 - DNA, 335 bp, Homo sapiens
catattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcattttgtgttgaagaggttttaaagcttccattgttgtctgcaactctgaaggg

SEQ ID NO: 13191 - DNA, 335 bp, Homo sapiens
ggaaggtgcaatataacaaatgtgcatattataatgaggaatggtactaccgttccagattttctgtaattgcttctgcaaagtaataggcttcttgtccctttttttttctggcatgttatggaatgatcattgtaaatcaggaccatttatcaagcagtacaccaactcataagatcaaatttcattgaatggtttgaggttgtagctctataaatagtaagtttttaacatgcctgtagtattgctaactgcaaaaacatactctttgtacaagaagtgcttctaagaatttcattgacattaatgacactgtatacaataaatgtgtagtt

SEQ ID NO: 13192 - DNA, 313 bp, Homo sapiens
gagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataatt

SEQ ID NO: 13193 - DNA, 339 bp, Homo sapiens
ctgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttactttcaagaagaagaagctgcggaagcccagacaccaggaaggt

SEQ ID NO: 13194 - DNA, 400 bp, Homo sapiens
  misc_feature 2, 24: n = A,T,C or G
tnagaaatacaaatactttagttngatcacatggcacctgactactgcttagaaaatggtaagacttactacataaatcatgagtcactattgacatctactatatcatatcataggttaggtatctaattataaatagtcaaatcagctgactcaaggtggcatagctcaagcagaggaagataatacaagttgagtatggatttaacactctaaacctgtcagcactgtaggaaaagtaacttaaaactgcacaccccacttatgcataatcatcagatataaagagggtacattcctgtaatttattgttgctctagtgatcttaaagaattaagtccacattcataaagtccaaacttgtctccaaggatttgctttgactttgggagtatctgga

SEQ ID NO: 13195 - DNA, 333 bp, Homo sapiens
ttcacgttctggccacatccaccaccatgatgttcgggtagcagaacaccatgtggccacacttgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtcccttggcagtccaatgtcctggcaacaggagggggcaccaagtgatcgacacattcgcatctggaatgtgtgctctggggcctgtcttga

SEQ ID NO: 13196 - DNA, 335 bp, Homo sapiens
tagatctgtttactctagttgaacattttctatacaattgaaagcaacctataatagataaatccatcattgcatttaaacaatgaatttccttattctcaaaggacaaatacgtctggattatgtggtaaattgctactcagctatggtgaaatatttatactattctaggcacaacactaggaactaggtgattctgaaacaaaaggaatattttctgttgttgctttaattaccaaggttattttttttttaatctcaacactgacaaaatgaaaccaaatatctcttcctcaccatttctcaaggaggctgcctgttggaattgttttggg

SEQ ID NO: 13197 - DNA, 115 bp, Homo sapiens
  misc_feature 10, 26, 30, 80: n = A,T,C or G
gttttgttantgtgtgtattacttcnagcnagaatgggaaatgctaattcagctcctccaggcagcccaatggggctggnggctttgagaattattaaactcttttctctgctgc

SEQ ID NO: 13198 - DNA, 211 bp, Homo sapiens
  misc_feature 31, 34, 40, 46, 47, 53, 54, 61, 62, 63, 64, 69, 89, 90, 96,116, 152, 163, 208: n = A,T,C or G
gcctatctgcatcttctcacttgccaaaaanganaatggnttaatnngggggnnattaacnnnnggggnccaaaaaaacccctaaaggnnaacggnaaaaaaaccttggcaattcncctttgggaaggcaatgaaaacccttaaaaaacctntcaataacagnaagcggaaaaaaggaaatggaaacctccaattacctttggatctntta

SEQ ID NO: 13199 - DNA, 333 bp, Homo sapiens
ggcacctggaacaccagtgagacagaaccattcactcccctggaaagggggttgaagccagggaaccaagtggtctaattcagtggatcccacccccacggagcccagcaagctaagatccactggcttgaaattcttgctgccagcacagcagtctgaagtcaacctgggacactcaagctcggtagcaggaggggcatccaccattactgaggcttgagtaggctgttttcccctcacagtgtaaacaaagcagggggggaagttcaaattagggggggagtacaccacagctcctcaaagctgctgtagccagactgccactctagattc

SEQ ID NO: 13200 - DNA, 244 bp, Homo sapiens
tcgcatcatcggtgccaaggacccacgccatccatccagatgaacgtggcccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaac

SEQ ID NO: 13201 - DNA, 172 bp, Homo sapiens
  misc_feature 8: n = A,T,C or G
ttctgacnagcttccaaaatgtgttcccttttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagttt

SEQ ID NO: 13202 - DNA, 400 bp, Homo sapiens
  misc_feature 2, 5: n = A,T,C or G
ancgnaagactggagctcgcgcgcctgcaggtcgacactagtggatccaaagttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaaagaaggccctgaagctgatggggtcaaatgaaggtgaattcaaggctgaaggaaatagcaaattcacctacacagttctggaggatggttgcacgaaacacactgggga

SEQ ID NO: 13203 - DNA, 357 bp, Homo sapiens
agcggagatcataattaaatggccgttaagctgtgaggacaaggagatggtgtagattaaatgttaagaatggccatcccgaaacctgtcggtgttgttgattacagcagagtggctgacatcccatggagcacttccggtggccaggtgagtttctccagccctatctcagggagtctctaggccatgcattgaataagtcttaacctctggcatctatgaatgtgaccacctttggaaatgaggtctttacagatgtaatcaagttaggataagataagcaggatggggctgaatcctatatggcagacatccttatgcagggagaagagacacggggcacagacacacggggtg

SEQ ID NO: 13204 - DNA, 264 bp, Homo sapiens
  misc_feature 2, 219, 240, 255: n = A,T,C or G
ancgaagctggagctcgcgcgcctgcaggtcgacactagtggatccaaagttttttttttaatgtgaacctagatgcagcaccgactttttaaacttgaaaaaactggtataatgttaacttttaaaaataacatttggacacactagtaattgatttttgtttacagattgttttgtttacaaattgttagtctttgtttctatgagatacttttagngtgactttttaaatgtcttanaaattaaaagttgtncaaaaagtg

SEQ ID NO: 13205 - DNA, 362 bp, Homo sapiens
gaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaag

SEQ ID NO: 13206 - DNA, 335 bp, Homo sapiens
ccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttggaggagtgcccttca

SEQ ID NO: 13207 - DNA, 335 bp, Homo sapiens
gtcgcccccttcaggctaagtctcaggcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggaca

SEQ ID NO: 13208 - DNA, 335 bp, Homo sapiens
  misc_feature 246: n = A,T,C or G
cccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagantattggttaaatcctgccagtcttttctcttcaagccagggtgcatcctcagaaacctactcaacacagcactctaggcagccactatc

SEQ ID NO: 13209 - DNA, 333 bp, Homo sapiens
gtttagtagtgcaaatatctgccatttttagcttttatagtagaatatgggattttttcccctatcaaggctcttaaaatgagggattctccaaatacttgaagagagttcaggtgttgggatggccaaaatcaatgagaaatgccccccctacacatcggttttaggctcaagcctggcagatcttggtcatgacacttaacctttctgggttgatcatgactcctcaataaagatgggatttggctcagtaatttctaaggtcttttttcatatcttatttgtttcttcgaaaaaaagactgccttgaaagattttgccacttctaaaatt

SEQ ID NO: 13210 - DNA, 152 bp, Homo sapiens
aaaaagttagccgggtgtggtggcatgcacctgtagtcccagctactcgggaggctgaggcaggggaattgtttgaacccaggaggcggaggttgcagtgagcagagatcgtgccactgtactccagcctgggcaacagagcgagactctgt

SEQ ID NO: 13211 - DNA, 332 bp, Homo sapiens
aaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtg

SEQ ID NO: 13212 - DNA, 226 bp, Homo sapiens
cttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagatttttttg

SEQ ID NO: 13213 - DNA, 335 bp, Homo sapiens
gctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgac

SEQ ID NO: 13214 - DNA, 195 bp, Homo sapiens
agaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttac

SEQ ID NO: 13215 - DNA, 336 bp, Homo sapiens
ctcacccatttcactttcaagtgtggctatagactgtaattagaaacaaaagtaattctgtacctctgggatatttctgaaagcctcactgcaaaacagaaactgaaaaatatctgtttattattcataccttcatacaaatataggggaggcaaaattttacttctaccaccttaggcttttttacctgggcctcagaattagactgatataagacaaatcaatagaaaagcatgcacatgtatgtagtatgttttatatggtgcagaaggctccataaggagtttaaaacccaacgatgcagttagagttggacacttacatagtgaattggac

SEQ ID NO: 13216 - DNA, 334 bp, Homo sapiens
gaaactgtcctgcaaagcacatctggcagtcatgccctggttgagcagctgcatccccatgctcctggctagagtgacagcaccatggccagccgcataaagccatactccaagttttctgacccactgtgtgcctgcacacacccctaccctgcgaaacagcccagtgagcccacccctggcaaggctgcaccaccatcactacaaacttccttaacctaggccactgagtaacttgcaaatgttactagtgtggatcacagctgaataaactacatggagactacacttactgcatccatgtagaaccaaggccagtataccccaatgaaca

SEQ ID NO: 13217 - DNA, 332 bp, Homo sapiens
gcactttaaaaacgggtctagaaaatagtgacagcccttgtccctcactccagaattaaacaacaacaaaccatacacagcacattttccaggtacttttatagagaatgactgataaccaagaatcagaatacatttcttgcacaaaactgttggttttgaagaaggtgctgtaaaggcatcagtacttcatgtcactgtattatcactaatgaaatttttatttttattttttttgaggcagagtctcactctgtcgcccaggctggagtgcagtggtgccgtcttggctcactgcaagctctgcctcccgggtttacgccattgtcctg

SEQ ID NO: 13218 - DNA, 319 bp, Homo sapiens
ttcggcacgagagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtccctttttgtgcttccttcccctc

SEQ ID NO: 13219 - DNA, 333 bp, Homo sapiens
gactacaggcgcgcgccaccatgctaggcttttatatttttagtagagacggggtttcaccatgttggcgagactggtcttgaactcctgacctcaggtgatccaccagccgtggtcccccaacatactgggattacaagccgtgagccaccgcgcccggccgccatcggtggttcttaactgcgggtgcagtgcttctttgtaacattaagtgtatcctttacctgtcgctagataatgaatggtatgttacctgcatcattggtttaaaaagacgaaccgttttttttaaagaacactctttaaaaaaaagaaccgtggaacaatgaatta

SEQ ID NO: 13220 - DNA, 327 bp, Homo sapiens
gaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgttt

SEQ ID NO: 13221 - DNA, 255 bp, Homo sapiens
aaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactg

SEQ ID NO: 13222 - DNA, 206 bp, Homo sapiens
ctcgccgattcggcacgcggctaaataagctatcgggcccataccccgaaaatgttggttatacccttcccgtactaattaatcccctggcccaacccgtcatctactctaccatctttgcaggcacactcatcacagcgctaagctcgcactgattttttacctgagtaggcctagaaataaacatgctagcttttattccagtt

SEQ ID NO: 13223 - DNA, 339 bp, Homo sapiens
gggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaac

SEQ ID NO: 13224 - DNA, 298 bp, Homo sapiens
atcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaata

SEQ ID NO: 13225 - DNA, 333 bp, Homo sapiens
acagaaccctctaaatccccttgtaaatttaactgttagtccaaagaggaacagctctttggacattaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaat

SEQ ID NO: 13226 - DNA, 198 bp, Homo sapiens
tgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgattttt

SEQ ID NO: 13227 - DNA, 331 bp, Homo sapiens
gaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatc

SEQ ID NO: 13228 - DNA, 333 bp, Homo sapiens
gtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcg

SEQ ID NO: 13229 - DNA, 324 bp, Homo sapiens
  misc_feature 21, 45, 87, 96, 140, 181, 292: n = A,T,C or G
ttcggcacgagctcaactctncagccctctgcctagcaggctggntctccctgcaaagcccatacctgtgggacctggccctcctgnggtctgagnaccactcccctgccccaggagccactcccactccagctgcctgnttccagcaggttcccagtgtccccgacaagcccctgctggngtctccatctcctgccaagcatcctccagtgcctcctcctgtgggcctggcctcagggctatggacagactcctgtcccatcccagagacccctcgtgatcgtgccctggngggggtgttgcccccgcctgcctttgcctccg

SEQ ID NO: 13230 - DNA, 226 bp, Homo sapiens
  misc_feature 183, 204: n = A,T,C or G
tggccctcgtggccgggggagtcctgttaatctgtccactgccaggcagcgtggccttggcagtggacggattaaagggctcccccagcccgcgtgggttatgggggcttttttctatgcccgtcgatctgcagcgaacgccaggtgcccgaaaccccccaaacccccctgcaggttggttgnaccccaacttcttttgccttnaagcaaaaaccccatatttaag

SEQ ID NO: 13231 - DNA, 326 bp, Homo sapiens
tctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggcttttcaggcctggcctttcctacagggagctcagta

SEQ ID NO: 13232 - DNA, 329 bp, Homo sapiens
gctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctg

SEQ ID NO: 13233 - DNA, 330 bp, Homo sapiens
ggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccggggtggttaaacttcgca

SEQ ID NO: 13234 - DNA, 336 bp, Homo sapiens
ccctgatgtccagcgagtggatgccgcctttaactggagcaaaaacaagaagacatacatctttgctggagacaaattctggagatacaatgaggtgaagaagaaaatggatcctggctttcccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgc

SEQ ID NO: 13235 - DNA, 100 bp, Homo sapiens
  misc_feature 2, 6, 42, 44, 51, 53, 58, 60, 61, 62, 70, 72, 86, 89, 93,94, 96, 98: n = A,T,C or G
gncacntatagtgagtcgtattacaattactgagacactagngnatccaantnattcnannngagccatntnggggcgtgttcccnttnaaannancnga

SEQ ID NO: 13236 - DNA, 322 bp, Homo sapiens
  misc_feature 34, 57, 64, 164, 167, 197, 225, 239, 281: n = A,T,C or G
ttcggcacgagcttcacctttgggctgctgccgnggattgacaactttgcccacatntcagggntcatcagtggcctcttcctctccttcgccttcttgccctacatcagctttggcaagttcgacctgtaccggaaacgctgccagatcatcatctttcaggnggncttcctgggcctcctggctggcctgggggncctcttctacgtctatcctgtccgctgngagagggggggagntcctcacctgcatccccttcactgacaagttctgtgagaagnacgaactggacgctcagctccactgagctggctgcgggctc

SEQ ID NO: 13237 - DNA, 107 bp, Homo sapiens
gtccacttctgcacttggtcctgcgcttgagggggggtgtctaagtttccccttttaaggtttcaacaaatttcattgcactttcctttcaataaagttgttgcatt

SEQ ID NO: 13238 - DNA, 309 bp, Homo sapiens
  misc_feature 303: n = A,T,C or G
ccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtgggggctgtagccgtctctgctgccccaggctctgcagcccctgctgctggttctgcccctgctgcagcngaggag

SEQ ID NO: 13239 - DNA, 334 bp, Homo sapiens
cagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggat

SEQ ID NO: 13240 - DNA, 334 bp, Homo sapiens
gccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataattgaaagctaagcctcgggctaatttc

SEQ ID NO: 13241 - DNA, 193 bp, Homo sapiens
cttaagtgttaataagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaaccctt

SEQ ID NO: 13242 - DNA, 288 bp, Homo sapiens
gttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataattagaagtctt

SEQ ID NO: 13243 - DNA, 363 bp, Homo sapiens
gttttgtcccctccctatgtttttacatttactctcccaacagctgtctacaagcttatatgggatcccttgtattttatagaagctcttccttttgtagacctgtgaattcttagaatgctatgccccaaatcttctgtatatcacactctcaattaaatggagatttttgctgtttgcaagaatgtgagtcttaaaagagtgtgaagataaccaatctaaccctggaaaccccattcctttagaccaatcctttcccttctaacctcccctcccaggtttctcctaatttaggcaagtgtaactctcccagcaaagttgagaacattgattaaggtaatgcatgtgaagactctttgtaag

SEQ ID NO: 13244 - DNA, 334 bp, Homo sapiens
  misc_feature 318: n = A,T,C or G
gtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgnctccctccttgctttc

SEQ ID NO: 13245 - DNA, 305 bp, Homo sapiens
  misc_feature 258: n = A,T,C or G
cacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgngcaacttgtaactaggtgtttatggaataaaggagaatggaaaaaag

SEQ ID NO: 13246 - DNA, 189 bp, Homo sapiens
ttcggcacgagtttaaatggatttcagccattgtaaacagaagacaatttaagtccaattcactgttgaaaacttaattgaggctgggcaccgtggctgctttgggaggctgactcaggaggattgctcaaggccaggagttcaaaagcagcctgagcaacatagcgagaccctatctctgcaaaactt

SEQ ID NO: 13247 - DNA, 224 bp, Homo sapiens
  misc_feature 129, 203: n = A,T,C or G
gaaactttgtgctacatgacgacaaagctgctaaatctcctatttttttaaaatcactaacattatattgcaatgaaggaaataaaaaagtctctatttaaattcttttttaaattttcttcagttggngtgtttttgggatgtcttatttttagatggttacactgttagaacactattttcagaatctgaatgtaatttgngtaataaagtgttttcagagc

SEQ ID NO: 13248 - DNA, 333 bp, Homo sapiens
cgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggcccgaatcttccttcaggatatcaagaaaccagactgtgatgactgggagaagcg

SEQ ID NO: 13249 - DNA, 212 bp, Homo sapiens
ccctggtgttggttgcaaccaattattattttaagagagacagttaccaaccacctgactgctgggtgaggtggctcatgcctgtaatcccagcactttgggagcctgaggtgggtggattacctgaagtcaggagtttgagaccagcctggctaacatggtgaaaccccatctctactaaaaatactaaataaataaataaataaataaat

SEQ ID NO: 13250 - DNA, 332 bp, Homo sapiens
cgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaac

SEQ ID NO: 13251 - DNA, 117 bp, Homo sapiens
ggggacttgagggcctgagcaggaaagactggccctctagcttctaccctttgtccctgtagcctatacagtttagaatatttatttgttaattttattaaaatgctttaaaaaaat

SEQ ID NO: 13252 - DNA, 359 bp, Homo sapiens
catcggatgttgctattagattttctttctccgttcgagtctctgactggtgcatactttgcaaaggtgtgttcctggcaattgccaagagttagaaaaatgcaccttctctggtggccgttggggtgttgtttcacaggcagtggtgacagggccccttggctgtggctgtcttctccagcgccgtggataaagagatgggacagattctgtgcctctgtacgatttagagcgtaactgaccgcgtccaacacccgtttttccacttacaaagctggtggtgcgacgggcttggtgtctcccgtacgggaaggaggcctttgggccgctccaaagacgccctgtcgtaggaatggcct

SEQ ID NO: 13253 - DNA, 357 bp, Homo sapiens
ctcgtgccgcattattttgcctgttcctgacttggtaactttggaaacttgcatgtgtctttgaagtaaattaggttgccatattaaagcttcctctctgatttctccccagctggttggggaagaggacatcgagttaaactgtggttcttacagtgggagaatgttggtatctatgaatggttgctaccactttgctgttgagactatttaatcttcttttcacagggccaagacctagggtaaggcaagctagctgcctggggtgcaagatgtaagaaagcacacacttgtcaagccattctgtttacatttcatgccctagttgcttgttcacctcattctagtcccaccctg

SEQ ID NO: 13254 - DNA, 337 bp, Homo sapiens
ggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcg

SEQ ID NO: 13255 - DNA, 331 bp, Homo sapiens
  misc_feature 268: n = A,T,C or G
acaatatccacttgaaacccctttaaacttagttgggggaatacataccactgatttttggacccataatttgatgatttacagataattcttttgggaattaaatgtgtgtgaaagtgaaataactggagaacaaatgagggtcagagatagggatcaatcctataccagaaatttttttcctgcttcaataagggctagaaggtagtgccctatgtaggtctaggatttctttcttccttccttccttcctttctttttcttttgntccctccctccctccctctctctctctttccctcccttccttccttcctttctttttcctttc

SEQ ID NO: 13256 - DNA, 337 bp, Homo sapiens
  misc_feature 290: n = A,T,C or G
tgagaacttcgtggaggaacaaaacgatgagcaggaagagaggagccgggaggctgtggagcagtggcgccagtggcactatgacggcctgcacccatcctatctctacaaccgccaccacacctgatcccatcctgaagccggccaagaagacaaagcttgtagcaccattggcatccccgtgttccagcaatctttcccatgcaaaccggcccttcagagggtctcagcttggggtctgcagtggccagcagctcttgaaaagacgcatgcctttccttccagtgtgngaaaagtgtcctgactttcacctctttgcagaccatcttctgaggtg

SEQ ID NO: 13257 - DNA, 338 bp, Homo sapiens
gagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtgggaaggctccaacccgcccaatctgagcccgaggcctgctgagaagcatgggggccttgggatagttccagaatgaggatgtgcgtttctagctgctttgcg

SEQ ID NO: 13258 - DNA, 336 bp, Homo sapiens
cttggtcttgggacaagcaaaaattcctcaagcaagtcacaaaaggaatctgccataaaagattgataaattggaatacaataaaatagaaaacctctgtttaacaaaagtgatttgaaaagtaagaaagtaaaaaagcaagccatagaatgggagaagatattagtaatgcatctaaccaacagaatgtgtaaagaattcctataaattaacaagaaaaagacaacccagaagaaagtggacaaaacacattaagaagtgtttcacaaaagaggatctccaaatggccaataaacatgaaaagatgttcaacctcagtgagtcttcagagaaatg

SEQ ID NO: 13259 - DNA, 292 bp, Homo sapiens
ggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgag

SEQ ID NO: 13260 - DNA, 197 bp, Homo sapiens
aagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcg

SEQ ID NO: 13261 - DNA, 336 bp, Homo sapiens
  misc_feature 305, 318: n = A,T,C or G
cggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgntgcttgttggaanatgcatatagactaccgg

SEQ ID NO: 13262 - DNA, 328 bp, Homo sapiens
ggcgtgcgccaccatgcctggctaatttttgtatttttttagtaaacggggtttcaccatgttagccaggctggtctcaaactcctgtaatcccggctacttaggagcctgaggcaggagaatcgcttgaacccgagaggcagaggttgcatgtgagcagatattgcgccactgcactccagcctgggtgatagagtgagactccatctcaagaaaaaaaaagaaagaataaaacaacatgacaagctgggtattcataaagccctttggctacaaacacacagaaatgctgaataaaatttaaacgtccttttaaagtattttcaag

SEQ ID NO: 13263 - DNA, 335 bp, Homo sapiens
aaatcctttggttaaatcctttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgtataagattgtctta

SEQ ID NO: 13264 - DNA, 355 bp, Homo sapiens
taagtacttatatcaataaaagacagattgcttgataaataacaattgtattcagaagtgttcagctctggttctgattagtttatacttagtaccaataattttcaaagtccctccagcagagtactagacatcctcatccctactttatgcctttactggtcttatttgtaagaaaggccttccaaaaaagcttttaatctaagaaaaggcttaaagtttgaaataaactttcaaaaactgctaaagtagataatgaaaacatatatttagatatattttctagtttcagctctgacacataaaaagcatggaagtcattactcctcctatccttacaacaagaaaaaaacgg

SEQ ID NO: 13265 - DNA, 360 bp, Homo sapiens
  misc_feature 87, 173, 267, 287: n = A,T,C or G
caggacacagcagactttatcaaaaacatgattacagggacatctcaggctgactgtgctgtcctgattgttgctgctggtgttggngaatttgaagctggtatctccaagaatgggcagacccgagagcatgcccttctggcttacacactgggtgtgaaacaactaattgncggagttaacaaaatggattccactgagccaccctacagccagaagagatatgaggaaattgttaaggaagtcagcacttacattaagaaaatnggctacaaccccgacacagnagcatttgtgccaatttctggttggaatggtgacaacatgctggagccaagtgctaacatgccttggttcaag

SEQ ID NO: 13266 - DNA, 339 bp, Homo sapiens
aacacctctgattactcctgccatcatgacccttggccataatatgatttatctccacactagcagagaccaaccgaacccccttcgaccttgccgaaggagagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacg

SEQ ID NO: 13267 - DNA, 336 bp, Homo sapiens
gttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagc

SEQ ID NO: 13268 - DNA, 333 bp, Homo sapiens
ggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctg

SEQ ID NO: 13269 - DNA, 251 bp, Homo sapiens
ctgagatctagacatacctcctcctctcctccacataggcccacccaccaagaatccctacattggaaacccttggggttcaaggatcatgagtctggggcatgcaccctgggatcactgttcagagctgaaaatgcatttccccatggaaacattgatgttgatgtggtgccgttgtgctagagtccaagtacattttctggtttttgtgggctgatctgggctcttgctgccatttatcatatttctat

SEQ ID NO: 13270 - DNA, 336 bp, Homo sapiens
ctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattgg

SEQ ID NO: 13271 - DNA, 336 bp, Homo sapiens
gtgatttctcaaagagcactctttgctagcttcttcctaaacaaaatctactctaggaagatggcccacctggatgatggttccaggagggccagctcccttattgctttgctttctcttcctcctcttctggtaccttggggaactgatcacaaagagccttttgagggtgatggaaagctacccctccattcctcaggcagttttccaaagatgacacttggctaaatgctcagggtatttacagtcataggagataaactatcaacttgttactgttaaaaaaatcttgagatctgggatcttgatgcctgaaaatcccaagattggtacttg

SEQ ID NO: 13272 - DNA, 336 bp, Homo sapiens
ctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaacttgacttgtgaactatttgtattcagatatttacaagcaaagctgaaatgatgaaccaattgggaaagattactcactgaactaatgctttaaaagccactgaatttcatttaagttgcttttcttttgtaagcccaatattcttttttttcccataaaggataattatt

SEQ ID NO: 13273 - DNA, 335 bp, Homo sapiens
tacaactaatttttggagcattcatcgtgtgcctgacactttgaaatgccgcatacacttctcatataaccttcccagcatgccctgaggtgtaatcctggtaacgctgggagacaagtaattgaactgctctatgctactgttctttaaaacataggtaataagagtagcacagaatagttcagttgctagtctgcccgtggttatacatctaggaagcactagaatcaggataactagtgagcctaagttattgatggagaagtcatagctcttgggtatttaaaacgatttttactggaggtgtaatcacagtaaaatgcatgactccaaag

SEQ ID NO: 13274 - DNA, 259 bp, Homo sapiens
ctcaaaagaaggaagagaagatttgttatacaaattgaattaataatagtatacatataaactacttttaatttagtaaaacctaaactggtctttaacaagaagtgacaggataggtgaaaatgtattttggggaaaagtattttgagttttgctgaattaatatggttggtaaatctctctctgtgtaggatcactgtttaatgaaataatgcatattttttttctgccacccaaataaagatttttatctgtgttg

SEQ ID NO: 13275 - DNA, 335 bp, Homo sapiens
ttgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatc

SEQ ID NO: 13276 - DNA, 137 bp, Homo sapiens
gtagcacgccctcctgggccgtctggcctgtggctaatggaggtgacggcactcccatgtgctgactccccccatccctgccacgctgtggccctgcctggctagtccctgcctgaataaagtaatgcctccgcttc

SEQ ID NO: 13277 - DNA, 224 bp, Homo sapiens
aaaatattttgatgatttgaataaatgttaacttttaatctgcgccttaataatgactggttatctgtaaatatagaacagatacagattgtatttttctgtgggtttttgtccttttagtgatttttttccaaaaacgagagatggaattaacattgaaaatgggaaatttttctaactgaatcaattgttacatgaaaaataaatttatataacccctttgt

SEQ ID NO: 13278 - DNA, 335 bp, Homo sapiens
  misc_feature 307: n = A,T,C or G
cctgcccgtccgccagtgagtccttggtttttaataatgagaagtcctttcccccaaggtgtgagcattgcagcgcggtgtgtgtgtgtggttagagccagcttagtccttcactttgtcgaccgaagtgggagctcaacagctgcatgaggagggcagcgcgtgcattagccagtcgccactggagggctctgctgccctccgggcaatacactgtagttactgcctagccagcagcagtcttctgcatcaagaactgaaaccttgctcggaggggatttttatagcatcctttttaattaaaggngaaatacagattgctatataatgtctga

SEQ ID NO: 13279 - DNA, 342 bp, Homo sapiens
ctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactctt

SEQ ID NO: 13280 - DNA, 334 bp, Homo sapiens
tgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggag

SEQ ID NO: 13281 - DNA, 331 bp, Homo sapiens
  misc_feature 28: n = A,T,C or G
ctgaacctacgaatacaccgactacggnggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattccc

SEQ ID NO: 13282 - DNA, 333 bp, Homo sapiens
tcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttca

SEQ ID NO: 13283 - DNA, 335 bp, Homo sapiens
atcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcg

SEQ ID NO: 13284 - DNA, 337 bp, Homo sapiens
atgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccacccggtgttccaactgtttaaaattgatcagggaccatg

SEQ ID NO: 13285 - DNA, 337 bp, Homo sapiens
gtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggccgggggacactgtatttgatattttgtgatcagtgatcat

SEQ ID NO: 13286 - DNA, 172 bp, Homo sapiens
cccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaag

SEQ ID NO: 13287 - DNA, 335 bp, Homo sapiens
  misc_feature 263: n = A,T,C or G
caaggcgggaggattgcttgaggccaggagttcaagatcagcctgcgcaacatagcaccttccccagtggtcagggccccaaatctgctggcttcccagttgagtcctgcacacattaaagtctgagaaccactaggctaggatctgactctgcttggcaggcccagaaatcgttgttgggcagccttttcagctctgtttgacagaagcacctggagtgacacgggccagatttgactgaagatgagttgtgtatttggagnttgtgctgcctgacccatgcagtacacctaacatgcctgttgacccatttcacaggagcttgagaagctggc

SEQ ID NO: 13288 - DNA, 335 bp, Homo sapiens
aagacacagggagaacacaccgggactccacacctgtaaccacattctgtttgttcgccctaggaaagattgctgccttttcagcagaagggaaattcctaggattggctgtcccctgccaagcttggtggagcgtctgcaccttggctgcgccgcctgtgcatttgccagtttcctcccactgagaggatgggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctctttt

SEQ ID NO: 13289 - DNA, 338 bp, Homo sapiens
agctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactcccta

SEQ ID NO: 13290 - DNA, 338 bp, Homo sapiens
ctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattggg

SEQ ID NO: 13291 - DNA, 317 bp, Homo sapiens
gcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccgtgtgctggggccctgcaattggaatgttggccagatttctgcaat

SEQ ID NO: 13292 - DNA, 333 bp, Homo sapiens
gaaaccttgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatgggtgttttttagaaacctaattgaagtatattcaaccaaatactttaatgtataaaataaatattatacaatatacttgttt

SEQ ID NO: 13293 - DNA, 217 bp, Homo sapiens
gcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggagggagaagaaacctcaccttcagggcaaaccagggagacccttgtc

SEQ ID NO: 13294 - DNA, 335 bp, Homo sapiens
tgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttg

SEQ ID NO: 13295 - DNA, 333 bp, Homo sapiens
aagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatg

SEQ ID NO: 13296 - DNA, 195 bp, Homo sapiens
aagatattcctctttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttg

SEQ ID NO: 13297 - DNA, 323 bp, Homo sapiens
ttcggcacgaggaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttggggcactttcacaatgtagaggaaaaaaccaaatgaccgcactgtgatgtgaatggcaccgaagtcagatgagtatcccttg

SEQ ID NO: 13298 - DNA, 339 bp, Homo sapiens
cttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagtt

SEQ ID NO: 13299 - DNA, 295 bp, Homo sapiens
ttcttatttaagatatgaaatacctaaagcatcaccacaatatcaatcccattgttagtgaacagttgtttggattcagtgactgcctgaggctgggagtggaagatgaaatgaattgcaaagggtcacaaggatatttggggggtgatgggtatgttctgtggcagtggtttcccaggcatatacatctatcaaaactcattgaattgcatactttacatatttttatttttattatttgagacaaggtcttgttctgcactccagtctgggccacagagtgagactccacttc

SEQ ID NO: 13300 - DNA, 262 bp, Homo sapiens
agactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 13301 - DNA, 357 bp, Homo sapiens
  misc_feature 1, 287, 301, 326, 344: n = A,T,C or G
naattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaanaagcagtttgccanagtttagtctcaaaaaatgactggntggctctatttaaatcanaacccaatttcta

SEQ ID NO: 13302 - DNA, 336 bp, Homo sapiens
  misc_feature 13, 31, 53, 55: n = A,T,C or G
cagaacgctcggngagaggcggaggagcggnaactaccccggctgcgcacagntnggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtg

SEQ ID NO: 13303 - DNA, 270 bp, Homo sapiens
ctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataa

SEQ ID NO: 13304 - DNA, 332 bp, Homo sapiens
  misc_feature 3, 51: n = A,T,C or G
ccntgatattgcacctttggacatcggtggtgctgaccaggaattctttgnggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgt

SEQ ID NO: 13305 - DNA, 192 bp, Homo sapiens
  misc_feature 5, 48, 50, 61, 64, 76, 107, 153, 166, 170: n = A,T,C or G
cttgnttgaattgtgatacttataaaaggggactcaaaaatccaagcngnctactgtgttnaanttaacaccacanccttccttatcagattataagagtagaaaanttaacacttggtgtgtgaatcttcaggaaaatgagctatttcatangctcaaacaagcngctnccttttccagagaatatagaat

SEQ ID NO: 13306 - DNA, 201 bp, Homo sapiens
  misc_feature 56, 106: n = A,T,C or G
ggagtaagaacccctggaccaccagccccagcaagagcacaagaggaagagagagnccctcactgctggggagtccctgccacactcagtcccccaccacactgantctcccctcctcacagttgccatgtagaccccttgaagaggggaggggcctagggagccgcaccttgtcatgtaccatcaataaagtaccctgtg

SEQ ID NO: 13307 - DNA, 334 bp, Homo sapiens
cttgttctcaactactctgcttttataactcaagaaacagacaacattttagacaactgctttttactttcaaggaaacttaagagaatagaaatgtattggccatacaccttttcttgaaagctactgggcgtggggcggtgggggagaactcggatccaacgtggaagagtagtttaaaaagccccaggatagggaactgttcagtggatacaggtaatatcaaagaaaaagattcagttaatgtgcctgacaagtaaaaaaattactgctaatcatttgatgggtctgtaagagcatttggcaaaaattagcagtaggtttatagtaaata

SEQ ID NO: 13308 - DNA, 202 bp, Homo sapiens
  misc_feature 6, 7, 19, 24, 32, 46, 58, 109, 175, 181, 187: n = A,T,C or G
cctganngagacgcggganccccnacggaganacgcttccaggagnggccctgtccantcctcgcttgtcctttcccttgttctccccctgccccccgtctctatcctntgtggccttcagctaatttctgctcccctgagaattcgtccttcagccccatcatgtgctttgggnatgagngtaaanaaaacggggctgtgg

SEQ ID NO: 13309 - DNA, 214 bp, Homo sapiens
ttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactat

SEQ ID NO: 13310 - DNA, 324 bp, Homo sapiens
  misc_feature 4, 135, 180, 183, 201, 252, 316: n = A,T,C or G
cggnacgagtggatccacactcagcccaatgagtccccgcagttatcaccccaggatgtcaccacccatgccaagatcatggctgacaacccatcttgggatggcgagaagaccattatcatcacatgcagcttnacgccaggctcctgtacactgacggcctacaagctgacccccagnggntacgaatggggccgccanaacacagacaagggcaacaaccccaagggctacctgccttcacactatganagggtgcagatgctgctgtcggaccgtttccttggcttcttcatggcccctgcccagtcctcgnggaactac

SEQ ID NO: 13311 - DNA, 162 bp, Homo sapiens
  misc_feature 17, 37, 40, 72: n = A,T,C or G
cttcgtgccgaaattcngcacgaagaaacagttcagnganctttagtgcattgtttattgtgtgggtttctntcttcccctcccttggtcttaattcttacatgcaggaacactcagcagacacacgtatgcgaagggccagagaagccagacccagtaaga

SEQ ID NO: 13312 - DNA, 174 bp, Homo sapiens
  misc_feature 87, 118, 145: n = A,T,C or G
attaaaaaattctcagtatttctgcttctcacgttttgttttgggaaataagaattctggctgtaggagatggcggggggaggttantcttcccagagtcgcgtcatcacagaacagngttgctccttacagctgttatcccaanagaagaaaacgggagagagtgccggccac

SEQ ID NO: 13313 - DNA, 338 bp, Homo sapiens
  misc_feature 66, 159, 236, 294, 303, 305: n = A,T,C or G
ggcggaggtgcaggtcctggtgcttgatggtcgaggccatctcctgggccgcctggcggccatcgnggctaaacaggtactgctgggccggaagggtggtggtcgtacgctgtgaaggcatcaacatttctggcaatttctacagaaacaagttgaagnacctggctttcctccgcaagcggatgaacaccaacccttcccgaggcccctaccacttccgggcccccagccgcatnttctggcggaccgtgcgaggtatgctgccccacaaaaccaagcgaggccaggccgctntggaccatntnaaggtgtttgacggcatcccaccgcccctacga

SEQ ID NO: 13314 - DNA, 332 bp, Homo sapiens
  misc_feature 210, 277, 304: n = A,T,C or G
cagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcantttgggggtgacatctcaaaggccaggaattccgttgacttgttggctgccagtaggggcggaaggnaaaggccggaggcgagccctggaggangggaagccacaacttccgagctgcccac

SEQ ID NO: 13315 - DNA, 335 bp, Homo sapiens
tgactctgcaagaggaattttcagagacatgtctttagacactgaaatgaatccagaaaaaaatttgttgggagtaagggatggtttgaggaatttagggtgtaccataatgtggagaccaggtcttatttgacagttatgccaaagaacaaacagttcctgcagctctcatgttgtattcaccacaaattcaggaagtggctgaagaaggggattacatgcctgcacaaatctttagtgctatcgagagtgtcaagctttgaaaccctttgaatacttctgaagagcaagcgcccactgatgctgaggtcaacaaaatcagagaagctgacatt

SEQ ID NO: 13316 - DNA, 148 bp, Homo sapiens
  misc_feature 80, 96: n = A,T,C or G
tttacactagcttctggtgatactcttttactgattttatatctcttaaaatggggatggatgtgacacctcataaaagngagctttgaactgtanataactcttaaagaaaatgtcattttagacaattaaaatatttgtgctcaac

SEQ ID NO: 13317 - DNA, 320 bp, Homo sapiens
  misc_feature 104, 111, 153, 174, 218, 229, 235: n = A,T,C or G
gctccttctaagccagctggtaccaccaagaattcttcaaataagccagctgtcaccaccaagtcacctgcagtgaagccagctgcagcccccaagcaacctgngggcggnggccagaagcttctgacgagaaaggctgacagcagctccagngaggaagagagcagctccagngaggaggagaagacaaagaagatggtggccaccactaagcccanggcgactgccnaagcanctctatctctgcctgccaagcaggctcctcagggtagtagggacagcagctctgattcagacagctccagcagtgaggaggagga

SEQ ID NO: 13318 - DNA, 222 bp, Homo sapiens
  misc_feature 23, 152, 165, 192: n = A,T,C or G
cgccagcgtgatcacctcagctntcttctctcctctcctttccattctctctatggggaggggagcaggcaggaggagcagaaattgccaacattgcacagccaggctgggagcagcctagggagagcccccatcatgcccaccacccactntggcactggcttnatcctttacctatccccttccaccctnctttgctgcttaataaattctgaacttggt

SEQ ID NO: 13319 - DNA, 332 bp, Homo sapiens
ccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgag

SEQ ID NO: 13320 - DNA, 332 bp, Homo sapiens
  misc_feature 125: n = A,T,C or G
ggaaaattaattaaggtagagaaatgtaaaaatggtggccactgaactagttttctatatgaattatgtgaaggaattttatggatgtttattcagaccatgacagactaaatatgaattttggngatccatttttaagtagggctttcatatttttcaagagatccctctgtcaatattgtttgggtcttcttcaaaatcttgataatagaaagggtttataagatacttatataggcatgtatgtatatgtacacacatatatatcatatttatctttaggaaggtatactttcaagattacattgtaaatgacagcatctgaaagtgtc

SEQ ID NO: 13321 - DNA, 337 bp, Homo sapiens
ctctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacag

SEQ ID NO: 13322 - DNA, 325 bp, Homo sapiens
gtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccggttttggcaatccatttcggcaaaagaattcacccctgaggtgca

SEQ ID NO: 13323 - DNA, 255 bp, Homo sapiens
  misc_feature 28, 92, 99, 156, 170, 173, 206, 208: n = A,T,C or G
gggaagggctcgccgggtgccaaatganctgtcctaactctgcggggctgcagcttcctgcatgatgctggggagcttggcgcctgacccangatctanaaggcactctgggcaggccgcgctccgcccacgaaggtacccaaccctctgggatanatgcaggaagcganggntaagacccattttcacccaacttctcgccgcangnctggcttaccacacgctcctccccattcccagtgagccgctttttgc

SEQ ID NO: 13324 - DNA, 222 bp, Homo sapiens
  misc_feature 38, 41, 44, 109, 112, 145, 175, 196, 202: n = A,T,C or G
ttcggcacgagcttgtttggggttctgtgggtttgggnggnaanagggccatctgcctgaatgtaacctgctagctctccgaaggccctgcggacctggcttgtgtgancgngtggacagtggcggccgcgctgtgcctgctcgngttgcctacatgtccctggctgttgaggcnctgcttcagcctgcacccctnccttgnctcatagatgctccttttga

SEQ ID NO: 13325 - DNA, 329 bp, Homo sapiens
  misc_feature 104, 149, 172: n = A,T,C or G
atcctggtgtcgccatgggccgccgccccgcccgttgttaccggtattgtaagaacaagccgtacccaaagtctcgcttctgccgaggtgtccctgatgccaanattcgcatttttgacctggggcggaaaaaggcaaaagtggatgantttccgctttgtggccacatggngtcagatgaatatgagcagctgtcctctgaagccctggaggctgcccgaatttgtgccaataagtacatggtaaaaagttgaggcaaaagatggcttccatatccgggtgcggctccaccccttccacgtcatccgcatcaacaagatgttgtcctg

SEQ ID NO: 13326 - DNA, 339 bp, Homo sapiens
tcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcatttgttgtaaacaaacaagttaagggcaagattcttgccaagagaattaatgtgcgtattgagcacattaagcactctaagagccgagatagcttcctg

SEQ ID NO: 13327 - DNA, 356 bp, Homo sapiens
  misc_feature 84, 162, 296: n = A,T,C or G
cgcgtctacgaagccggacctgtagcagtttctttggctgcctgggccccttgagtccagccatcatgcctatccgtgctctgngcactatctgctccgacttcttcgatcactcccgcgacgtggccgccatccactgcggccacaccttccacttgcagngcctaattcagtggtttgagacagcaccaagtcggacctgcccacagtgccgaatccaggttggcaaaagaaccattatcaataagctcttctttgatcttgcccaggaggagggagaatgtctttggatgcanaattcttaaagaatgaactggacaatgtcagagcccagctttcccagaaagacaaggaga

SEQ ID NO: 13328 - DNA, 326 bp, Homo sapiens
  misc_feature 313: n = A,T,C or G
aatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattataatttgggngcatccctacttc

SEQ ID NO: 13329 - DNA, 187 bp, Homo sapiens
gtggttgttgtgatagataaccttaattgtgttttcttccaaaacgggtgaattcacataaaagggcatcagaaaaatacaaagacaacccatcaatatcaggagcctgagcatgagttaaagcatgtggatggcctagagccatgtttttaaaattgttattaaatattggttttttacttaaatc

SEQ ID NO: 13330 - DNA, 103 bp, Homo sapiens
  misc_feature 80: n = A,T,C or G
agagtggagagtactggattgaccccaaccaaggctgcaacctggatgccatcaaagtcttctgcaacatggagactggngagacctgcgtgtaccccactca

SEQ ID NO: 13331 - DNA, 282 bp, Homo sapiens
  misc_feature 39, 79, 244, 274: n = A,T,C or G
ctggagtgcagtgatgcaatcttgatctcggctcactgnaacctctgcctcccaggttcaagtgattcttgtgcctcancctccagagtagctaggattacaggcatgcaccaccacacccgactaatttttttgtatttttagaagatatgaggtttcaccatattggccaggctggtctcgaactcctaacctcaagaaatctacctgcctcagcctcccaaagtgctgggattataggagngagccaccacacctgcctccaaaatgcttntatgccta

SEQ ID NO: 13332 - DNA, 328 bp, Homo sapiens
  misc_feature 139, 209, 225, 292, 312, 327: n = A,T,C or G
agctagttctgctgttgcttcacgagttctgagcattctctgctagcctatggaagctgcagccctcggaggacagaagtgttgtgcgcccaacagaaccctctgagacgcaagctgctcccttggctagctcatatgnggaaatagccctgtaatttcgaggttgaaggggcccggccaggactcggggaagggtggcctgagagcancgatgacctctggggncactgtcccaggagggacttcacctggaacaagagctggaggcagccgcttgcccaggaggcttgtnccctgaggcgcttcgccagngaggtgcgggctcang

SEQ ID NO: 13333 - DNA, 328 bp, Homo sapiens
  misc_feature 58, 223, 234, 272: n = A,T,C or G
gtttttggctccccaagcatcatctcacgaggagaactttacacctagcacagctggngccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttanctgcaactggnaaaggagaagggtagttttgaaggtgtgacaccagttngctccagaaagtttaaggggtctgtttctcatctccatggacatcttcaacagctt

SEQ ID NO: 13334 - DNA, 337 bp, Homo sapiens
  misc_feature 90: n = A,T,C or G
agagaggagtattgctcaatgcgtgctatgtgcaactcctcaggccttgtgccacctccatgctgagccctgaagcagggtgtcctgggngcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaag

SEQ ID NO: 13335 - DNA, 329 bp, Homo sapiens
tattcctccttttttctttgagagcatcattatctcctaaagccacaggtccatcttgtaggatcctttttaccctctgaaattagtagatcagtttgcattttaaaccacacaggatgcaaaaacatctccgtttgggaactggacaaggtacaatccctgtgtgtcaacagacagttgtggcatctcctgcagagctgtcccaggaagtgtctgcatctcagatgctgatgacatagactactcaggaaggcagccttcgtgctctagattatactcaagtataagcaatcagcatcatccaggtgtcacaggagggcctttgaagg

SEQ ID NO: 13336 - DNA, 323 bp, Homo sapiens
ttcggcacgaggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaag

SEQ ID NO: 13337 - DNA, 325 bp, Homo sapiens
  misc_feature 110, 145, 154, 176, 193, 211, 214: n = A,T,C or G
ctcgggtaacaggaaggtatatttagcactgcccccaccacctacctaatctgagatcatgaatctgggaggaaaaaaaatgcatgtaagatgaaggttaacaagctggngtggtaggagccacttggctttttaaacagctggngtgtcccanctctccctacaccaggccaagnggagaaagacagggtgnggccccaccacatcaggntgnttctgatgacttttgcctctactcctcagaaattattgatatctggtcttaatgatctgaagaaagcatctgccagctcattcatctccaaaaactcacactgaataactg

SEQ ID NO: 13338 - DNA, 275 bp, Homo sapiens
  misc_feature 157, 163, 170, 192, 196: n = A,T,C or G
cttgtaagccatgacattaaagctgccaattgattacctccttttctttcccccatctaggtggcccacaaactctttaacaacttgaaataaatgtgtggacttaattcaccccagtcttcatcatctgggcatcagaatatttccttatgggttnggatgnaccattngtttcttatttgtgtaacctgnaagntcacatgaacctcatgggtttggcttaggctggtagcttctatgtaattcgcaatgattccatctaaataaaagttcta

SEQ ID NO: 13339 - DNA, 331 bp, Homo sapiens
  misc_feature 68, 188, 207, 235, 268, 289, 310: n = A,T,C or G
ttcacacagaggtggcaatgttacactgccatgtaaattttatcgagaccctacagcatttggctcangaatccataaaatccgaattaagtggaccaagctaacttcggattacctcaaggaaggtggatggtttttgtttccatgggataccacaaaaaaacctatggaggctaccagggtagagngtttctgaagggaggcagngatagtgatgcttctctggtcatcacanacctcactctggaagattatgggagatataagngtgaggtgattgaaggattanaagatgatactgttgtggtancactggacttacaaggtgtgg

SEQ ID NO: 13340 - DNA, 327 bp, Homo sapiens
ggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccag

SEQ ID NO: 13341 - DNA, 333 bp, Homo sapiens
  misc_feature 326: n = A,T,C or G
ctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaaagactgggntaatgat

SEQ ID NO: 13342 - DNA, 335 bp, Homo sapiens
cgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagg

SEQ ID NO: 13343 - DNA, 321 bp, Homo sapiens
  misc_feature 20, 71, 80, 167, 198, 218, 264, 319: n = A,T,C or G
cttctgcatttcatcatggncatcctggctccaaatcctgaagcttttggcttgctcgtattgatttcagnctcctttgnggcaatgggccacattatgtatttccgatttgcccaaaatactctgggaaacaagctctttgcttgcggccctgatgcaaaagaagntaggaaggaaaatcaagcaaatacatctgtngtttgagacagtttaactgntgctatcctgttactagattatatagagcacatgtgcttattttgnactgcagaattccaataaatggctgggtgttttgctctgtttttaccacagctgngc

SEQ ID NO: 13344 - DNA, 331 bp, Homo sapiens
  misc_feature 77, 98, 132, 295: n = A,T,C or G
agattatcaataagctcctagtccagacgccatgggtcatttcacagaggaggacaaggctactatcacaagcctgnggggcaaggtgaatgtggaanatgctggaggagaaaccctgggaaggctcctggntgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccanctgagtgaactgcactgtgacaagctgcatgtggat

SEQ ID NO: 13345 - DNA, 327 bp, Homo sapiens
  misc_feature 2, 37, 66, 102, 155, 180, 253, 255, 266: n = A,T,C or G
gntaaaacccaaaaacatctgtgggttggactatgcncttctaactaaaatttgcaagtaacatanattctttaataatgattttcaaaaaggaaaacaagntaattaacaacttttttctatcttttcaggaaaaatattgaaggtgaacatgnggcgtatgctgctatgtgaagcagnagctgctgtcatggccaaggggtttgatatcctgggaataaaacctgtccaaaggatgtaatccttcataggntngaacactgtgngtttttaccaaaggggccattggcactgtttgcttttttacaatcatgtggacacaagcat

SEQ ID NO: 13346 - DNA, 332 bp, Homo sapiens
  misc_feature 200: n = A,T,C or G
attctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgntcggactatttgtagtcatgtacagaacatgatcaagggtgttacactgggcttccgttacaagatgaggtctgtgtatgctcacttccccatcaacgttgttatccaggagaatgggtctcttgttgaaat

SEQ ID NO: 13347 - DNA, 182 bp, Homo sapiens
  misc_feature 5, 8, 50, 80: n = A,T,C or G
gctgngcntgcctgctgtggcaccccaacaccccccaggccttgctaaanatggattggtttagggttgttttgttttgntttggtttgggcccttggactgctccctagccacctccatgttaccgcagctttccaataagtcacttttgttggcactgggccagaagacagttgtcatcc

SEQ ID NO: 13348 - DNA, 203 bp, Homo sapiens
  misc_feature 6, 10, 33, 34, 36, 39, 43, 48, 49, 50, 57, 103, 111, 136,159, 181: n = A,T,C or G
gcgatnttancgccccccccgcgccactctagnntntanaaanaattnnnacgaggntgttgaagacatatattaaaaaatatctaatttacaatattacagncacaaganagcccactgatgtgaagtttcaggngaaacagtgtaaagaaatgatgntaggtaaatatcactatttctnaaagtaaaggtatgggattgga

SEQ ID NO: 13349 - DNA, 400 bp, Homo sapiens
  misc_feature 7, 11: n = A,T,C or G
gtacatntatnaaaaatagctaatttacaatattacaggcacaagggagcccactgatgtgaagtttcagtgaaacagtgtaaagaaatgatgttagttaaatatcactatttctcaaagtaaaggatgtcattgtattagtagaatgttaaccctctcttttatgggtcagttacatcaacttcatcataaaccctcttcaaaaaacatgcattttaggacttggatatagtcaggtctgtgtttcattaagcatttgttcagattccagctctcttgctccacaaccattgatatttctcaatttatctataatttacaccctgactgtctccataaaagatataatgtttataaggaaagatatatgcaattagataataatttgaatgcttttaca

SEQ ID NO: 13350 - DNA, 294 bp, Homo sapiens
  misc_feature 11, 198, 257: n = A,T,C or G
ctccagggctncaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggnttcgacgttggccctgtctgcttcctgtaaactcccttccatgccaacctggctccctnccacccaaccaactttgccccccaacccggaaacaga

SEQ ID NO: 13351 - DNA, 339 bp, Homo sapiens
ctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagaca

SEQ ID NO: 13352 - DNA, 332 bp, Homo sapiens
  misc_feature 23, 43, 109, 277: n = A,T,C or G
cccagatttttctcatttagatnataaacataatagaaagggntagaattgcaatcttgtgtaacttaaaaagcagctagtttttatttcctaggttcgttccaccagncataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcanaggtacccagatggtatcatctctaaacctaagaatttatagaagcacttcctta

SEQ ID NO: 13353 - DNA, 330 bp, Homo sapiens
  misc_feature 172, 178, 184, 317: n = A,T,C or G
ctgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcngcccanactggnacccgttggaacaagattgtcctgaagaagtggtacacgatttttaaggaccacgtgtctctgggggactatgaaatccacgatgggatgaacctggagctttattatcaatagatgaagaatcctcatcttnctgccccgctttc

SEQ ID NO: 13354 - DNA, 294 bp, Homo sapiens
  misc_feature 87, 94, 160, 190, 275: n = A,T,C or G
atctcttctagagcacctgctatccccaacttctagacctgctccaaactagtgactaggatagaatttgatcccctaactcactgnctgcggngctcattgctgctaacagcattgcctgtgctctcctctcaggggcagcatgctaacggggcgacgncctaatccaactgggagaagcctcagtggnggaattccaggcactgtgactgtcaagctggcaagggccaaggattgggggggaatgggagctggggcttagctgggaaggtggnctgaagcagacagggaatg

SEQ ID NO: 13355 - DNA, 344 bp, Homo sapiens
  misc_feature 161, 336: n = A,T,C or G
ttcggcacgagtacattttcatatttaaacactagaccattaaatgtgccttgatgaggacattaatgataaagagataagtatccctaataagcataaaagctgagaaagcaaacattggagtaaagtcaatgtcacatcacttcaattcggttgtttgnttttctactagaggtttacattgaatctgctgtgggattctacttaagcatccaggactacggaccaccaagctcactatggcctgggtgtggatctatcctactgaatcatattccttgaaatcatgcgtctatctctagtaaatacgtaacagatgggctgtaatttacttgnttattctg

SEQ ID NO: 13356 - DNA, 323 bp, Homo sapiens
  misc_feature 274: n = A,T,C or G
ttcggcacgaggagcactccaggcagttagaagagaaaaggcaaaaagacatggagagttaatgtatttcctgatatttaagtagttttgtgttgttagaaaattataaatggagcaattaaggcaggaattggtcaggcatcagatattaaggtagcttggatgtgatggttacattgacaaacttgctctaaatatacagatttctttaacatattttgatatagaggaataatgtaataagactagggtattatgaatatcactctgacgncagtttgaaaagttaaaaagagataaatgcaaaagaaaagagaatttat

SEQ ID NO: 13357 - DNA, 325 bp, Homo sapiens
ttcggcacgagccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggacagcttctctttctttatctttctttctccttttttaagaaaacgagttaagtttaacagttttgcattacaggcttgtgattcatgcttactgtaaagcggaagttgagattattttaaaacttca

SEQ ID NO: 13358 - DNA, 326 bp, Homo sapiens
  misc_feature 156, 218, 310: n = A,T,C or G
ctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggngacaatgacccttccaagaatctttggttcaaggagcaccagttccctcttcattcttgaancagggagaaattgacctttgccttgtcgcccaggaagtggggctcggcacccataactaacacctcccacccttggaaaccatgtcttctgngggtgagatgaccatt

SEQ ID NO: 13359 - DNA, 325 bp, Homo sapiens
  misc_feature 3, 295, 314, 319: n = A,T,C or G
cancagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagnttattgcctactgccgagngaagngtggcc

SEQ ID NO: 13360 - DNA, 329 bp, Homo sapiens
  misc_feature 7, 10, 145, 197, 255: n = A,T,C or G
gcaaagnggncaagacagatgcttttgaaatgaccttgaagcagcaattgagttactacattaagtaagcgttggctactacaactgtgagtttaaacactttttacaaatgagtggaatcacgtttagaaaatattcaggatgntgaacttgatacttctgctttgtccttttttcacaaatttctgcatttgtgntcggtacctacctgaccaggtctggtatttttaatgtgagatgataatgccccttagnggataaggtacttaactgcaagctcttgcatttgcccagagaaaagctctccaatttagcaaaaatatacaata

SEQ ID NO: 13361 - DNA, 187 bp, Homo sapiens
gtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgttttgttgttgaat

SEQ ID NO: 13362 - DNA, 336 bp, Homo sapiens
tggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatgg

SEQ ID NO: 13363 - DNA, 334 bp, Homo sapiens
ctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagaggggaagtttaaaacccaaacttccaaaggtttaaactac

SEQ ID NO: 13364 - DNA, 300 bp, Homo sapiens
  misc_feature 75, 146, 207: n = A,T,C or G
ttccagaccaacctggtgccctacccccgcatccacttccctctggccacatatgcccctgtcatctctgctganaaagcctaccatgaacagctttctgtagcagagatcaccaatgcttgctttgagccagccaaccagatggngaaatgtgaccctcgccatggtaaatacatggcttgctgcctgttgtaccgtggtgaacgnggttcccaaagatgtcaatgctgccattgccaccatcaaaaccaagcgcagcatccagtttgtggattggtgccccactggcttcaaggttgg

SEQ ID NO: 13365 - DNA, 269 bp, Homo sapiens
  misc_feature 221, 229, 257: n = A,T,C or G
actattctctattcctattgaaatgatatcataaaaaccttactcttcaaaaatttaattaaactaaattggacatttgccataaaatagatactacaataatcagttcattttcacttttcatatttagaagtctcaaaaaacccaggagatagctattataatcttcatttttgcagatcatattactaagccttaagggtttaaataacttaactggnatgggtgnatcaataaggataggaagaaagaaattntttctatcatag

SEQ ID NO: 13366 - DNA, 331 bp, Homo sapiens
  misc_feature 35, 100, 158, 201, 246, 255: n = A,T,C or G
ggaatatgagaggctcttacttcactaagagctgncatatgtgaatgttttacagtcttttcaaacttaacatttaatgtgtgtcactcagtgctctagncgatcaggactgggtagctatttcgcatatatgtaaaatgttctcagccgggcacggnggctcacgcctgtaaccccagcactttgggaggctgaggcggncggatcacgaggtcaggagattgagaccatcctggctaacacggngaaacccantctctactaaaaatacaaaaattagcccggcgtggtggcatgcgcctgtagtcccagctacttgggaggctgaagc

SEQ ID NO: 13367 - DNA, 326 bp, Homo sapiens
  misc_feature 135, 144, 255: n = A,T,C or G
ggaaaccatctcccccaggaccttctgtctgggactcaggagtcctaaggaaaaggaattctaaaacatggggggaaggggaggtagagcactgatgggtgaaaaagtgaggccaacacacagggcaagtggggncgatggagncgaagcgctgaaggaatagggcggctttccttccagcgagcatcattcggctgttaccaaaacaaacatcttaatctgcacctttctccactggccatcttgtccttgggncagggggacatgggcacctcgggaggcccgggccctgcccagctacagttccacccctcagcttgaggacc

SEQ ID NO: 13368 - DNA, 337 bp, Homo sapiens
  misc_feature 126, 169: n = A,T,C or G
agacttctccgccgcctccgccgcagacgccgccgcgatgcgctacgtcgcctcctacctgctggctgccctagggggcaactcctcccccagcgccaaggacatcaagaagatcttggacagcgngggtatcgaggcggacgacgaccggctcaacaaggttatcagngagctgaatggaaaaaacattggaagacgtcattgcccagggtattggcaagcttgccagtgtacctgctggtgggggctgtagccgtctctgctgccccaggctctgcagcccctgctgctggttctgcccctgctgcagcagaggagaagaaaatgagaaagaagg

SEQ ID NO: 13369 - DNA, 347 bp, Homo sapiens
gttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatcttt

SEQ ID NO: 13370 - DNA, 113 bp, Homo sapiens
  misc_feature 7, 29, 91, 108: n = A,T,C or G
cggcacnagagtacttctagagcggccgngggcccatcgattttccacccgggtggggtaccaggtaagtgtacccaattcgccctatagngagtcgtattacaattncactg

SEQ ID NO: 13371 - DNA, 250 bp, Homo sapiens
  misc_feature 32, 68, 80, 108, 140, 145, 147, 176, 185, 199, 241: n = A,T,C or G
atacgtatcaaggacagtaactaccctggctnccgaagttttgccaaaacctcggatgcgtggccttntggccaggcgtntgcgaaatcatatggctgtagcattcgngctatccctgggggttgcagctttgtataagnttcgngnggctgatcaaagaaagaaggcatacgcanatttctacngaaactacgatgtnatgaaagattttgaggagatgaggaaggctggtatctttcanagtgtaaag

SEQ ID NO: 13372 - DNA, 100 bp, Homo sapiens
  misc_feature 24, 27, 47, 78, 82, 84: n = A,T,C or G
ggcgcttgccccggcctctggttntanaaagacttccaggaggtggngatccttaagccaagtacgaataggagccanctanantgggaatgggtctggc

SEQ ID NO: 13373 - DNA, 137 bp, Homo sapiens
  misc_feature 22, 42, 54, 82, 101: n = A,T,C or G
gtcggtcgcgagcgaacgaccnagagggtgttcgactgctanagccgagcgaancgatgcctaaatcaaaggaacttgtttnttcaagctcttctggcagngattctgacagtgaggttgacaaaaagttaaagagg

SEQ ID NO: 13374 - DNA, 333 bp, Homo sapiens
gcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggt

SEQ ID NO: 13375 - DNA, 278 bp, Homo sapiens
gcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagc

SEQ ID NO: 13376 - DNA, 108 bp, Homo sapiens
cttgttgatagtgtagttttctaaacgctgcaaatttgcagcctttaccactacaaagaagtttggatgagggattttttttttctttgtcaaaatagttcctgtttc

SEQ ID NO: 13377 - DNA, 233 bp, Homo sapiens
  misc_feature 220, 223, 226: n = A,T,C or G
gagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaagggcntgnagntaacctg

SEQ ID NO: 13378 - DNA, 280 bp, Homo sapiens
  misc_feature 6, 54, 97, 188, 264: n = A,T,C or G
ttcggnacgagcctgaacaaaaatgtaaaccgacgccggaaagcaaatggtatngaatacctttcttgcccataagggtttttacaaagaacgtgtntcactaggaactaggacactcatcggcccgagaccaactcctggataaaaggaataaggagaatcgtgtttgtaacgagttacaggattgnttctttcctggattttaaacttttgttaaattgtgaaattatgggaggagttttatagaaaaaaaaagtgaaatanagtcagatgggaaagc

SEQ ID NO: 13379 - DNA, 124 bp, Homo sapiens
  misc_feature 22, 46, 55, 82, 92: n = A,T,C or G
ctcgtgccgaattcggcacgangcactactttgatgacaacagcgnctcccctgncaatgagaatcagatcgagtccaaggnagcctatgtnctcttctaccaacgccaggacgtggcgcgacg

SEQ ID NO: 13380 - DNA, 153 bp, Homo sapiens
  misc_feature 11, 62, 107: n = A,T,C or G
gcattattganccttctctccgccagcttgcccagaaatacaactgcgacaagatgatctgncgcaagtgctatgctcgccttcaccctcgtgctgtcaactgccgnaagaagaagtgtggtcacaccaacaacctgcgtcccaagaagaagg

SEQ ID NO: 13381 - DNA, 129 bp, Homo sapiens
  misc_feature 7, 8, 76: n = A,T,C or G
ccactgnnctccagcctgggaaacagagtacttctagagcggccgcgggcccatcgattttccacccgggtggggnaccaggtaagtgtacccaattcgccctatagtgagtcgatacatttccactgg

SEQ ID NO: 13382 - DNA, 339 bp, Homo sapiens
cttttatgaggagcccactctggcagtaactaacccactctcttgataatgacagtaatctattcatgagggcagaggctttatgagctaatcacctcttaaaggtctacctcttaatattatcacaatggcaactagatttcaacatgagccctggaggagaccttcaaacctttgcaatcttgaatttgaaaacttctcttctgcagaactctccttggtttcatggcccaacagaatgtcattgcctggtattcaaggccattttgtggtctgtgtacaccatctacataatgttatttccatatactctgcaatacaaaccctttgcattaactg

SEQ ID NO: 13383 - DNA, 161 bp, Homo sapiens
ctaacaaaaattagctgggcgtggtggcgcacgcctgtaatcccagctacttgggagactgaggcaggagaatcacttgaacccgggaggtggaggttgcagtgagccgagatcacgccactgcgttccagtctgggcaacagagtgagactccgtcacac

SEQ ID NO: 13384 - DNA, 100 bp, Homo sapiens
  misc_feature 6, 7, 44, 45, 49, 65, 70, 84, 95: n = A,T,C or G
caggannactgacttaaatattcggggtgagtaagtatttgggnntaanatctgaacttttcatntgcanaggcaagaaaaatntttgacattgngactt

SEQ ID NO: 13385 - DNA, 106 bp, Homo sapiens
  misc_feature 12, 46, 49, 74: n = A,T,C or G
ggaacgcgcatncagccttgggaagcccaggcccggcagccatggnggnggaaggaggaatgaaatgtgtgaanttcttgctctacgtcctcctgctggccttttg

SEQ ID NO: 13386 - DNA, 169 bp, Homo sapiens
  misc_feature 117, 119, 128, 151: n = A,T,C or G
cagcaaacttttcaaagattgtcactttagcaattttttctttttctagagatcttcatgaaacctttcaaaaatccaatttacccaggggaaatattcttttatttgggtaaaatngnggagaacgnatattttagttcttatttcttgnttacctgctagatccaag

SEQ ID NO: 13387 - DNA, 338 bp, Homo sapiens
cccggttcccgggaggatgaagttcgtgtacaaagaagagcatccgttcgagaagcgccgctctgagggcgagaagatccgaaagaaatacccggaccgggtgccggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattg

SEQ ID NO: 13388 - DNA, 329 bp, Homo sapiens
gacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttc

SEQ ID NO: 13389 - DNA, 149 bp, Homo sapiens
  misc_feature 118: n = A,T,C or G
ctgattttctgctcagtcacaattttacttgaaagcaagaattgtcctagctccttttccattattccaaaacgtttaacgttcaaagcagggtctcattaaaaaagaaactactggntgatataattgagatattacaatttcagaat

SEQ ID NO: 13390 - DNA, 110 bp, Homo sapiens
  misc_feature 7, 16, 58, 72, 81, 83, 109: n = A,T,C or G
tcatcanatgttgaanacaggggtctcgggggtgggctccggcacccacatcctggantcaggactttcctnagtgactgngngtaggggggtttcagggctgaacccna

SEQ ID NO: 13391 - DNA, 233 bp, Homo sapiens
  misc_feature 2, 78, 102, 130, 158, 180, 204, 211: n = A,T,C or G
gnggaattgatgcgtgatgtttctaaagaagatcacagcaaaaggagcagttttgtttgtgtgcttctgagccatggngaagaaggaataatttttggaacnaatggacctgttgacctgaaaaaaatancaaactttttcagaggggatcgttgtanaagtctaactggaaaacccaancttttcattattcaggcctgccgnggtacanaactggactgtggcattgagac

SEQ ID NO: 13392 - DNA, 339 bp, Homo sapiens
ctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaac

SEQ ID NO: 13393 - DNA, 211 bp, Homo sapiens
agacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 13394 - DNA, 238 bp, Homo sapiens
  misc_feature 16, 40, 91, 117, 119, 135, 179, 186: n = A,T,C or G
aaaatgcaggaataantagaacctgttgtgcaaccacggnttaaccggagattttgaggctagggtgtgtttctttcgaacttttcggaangtctggaacatttcatttcctgtttngntacctgtgcctctgtnaatctacttttgcaattttaagtaataattttatgaataaaaangggaaangcttcctaattccacatagtatttgcattgttttataaataaatcccactta

SEQ ID NO: 13395 - DNA, 355 bp, Homo sapiens
  misc_feature 4, 41, 42, 57, 93, 100, 134, 137, 146, 174, 183, 212, 240,330: n = A,T,C or G
acanaaccgagggcgatgaagaagcagaggaagaacaagannagaaccttgaagcangtggagactataaatattcaggaagagatagtttgnttttttnggttgatgcctccaaggctatgtttgaatctcanagngaagatganttgacaccttttgacatgagcatccagngtatccaangtgtgtacatcagtaagatcataagcagngatcgagatctcttggctgtggggttcnatggtaccgagaaagacaaaaattcagtgaattttaaaaatatttacgtcttacaggagctggataatccaggtgcaaaacgaattctanagcttgaccagtttaaggggcagca

SEQ ID NO: 13396 - DNA, 249 bp, Homo sapiens
  misc_feature 4, 6, 71, 85, 119, 121, 202, 234: n = A,T,C or G
gtgnanagccctcagtcggggcaggccaggggaggggtgaagtggttgcctggacaccccacgggaggagnggcatctggggctnttggccctcccacctggagcctgttacccgttananagctgatacccttatttaaaactcacctcccaatcaccccaaacaaatggaagagaagagaaaggacatggcgtattttgnatttaaaagtaattgtattaattatttaaagngtggaaagcaaaata

SEQ ID NO: 13397 - DNA, 202 bp, Homo sapiens
  misc_feature 115: n = A,T,C or G
ccccaagaccttagggattgacacctgggcctcaggcagagcccagccctgggctggggggctcctcaggacccagagatgtgcctggaaccactcctgatgccatggctagagnggcccccctgacttctgcccggggtgttgacctcgcctcacctttcacagaccagaccggcacaggctttgagctcattataaccac

SEQ ID NO: 13398 - DNA, 358 bp, Homo sapiens
  misc_feature 181: n = A,T,C or G
agagatcgagtttttaggaggaaaaattctgcaacaccatggcaaccgtctacagtaatgattttctcaatactttcatttaaacaaaaataaaccctatacccatttacttgggtaactgtaaaatgggaatacagaatactagggacagagaatactaagttatttcaaggacttttgnggggtcctcaagtgtatcatggccccactattcaagtgagacttatggatagcagataataatgaagatgtggctttgattcagaatattttaataaataaatgaagatgcagctttgactcagaatattttcactgggtctacaacccacctattggtcatcctaccagggaagta

SEQ ID NO: 13399 - DNA, 312 bp, Homo sapiens
ctccacgcggagtccgagcgcgtgtgctgagacccgagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatg

SEQ ID NO: 13400 - DNA, 335 bp, Homo sapiens
gtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagt

SEQ ID NO: 13401 - DNA, 203 bp, Homo sapiens
  misc_feature 13, 44, 98, 176: n = A,T,C or G
tctgcttcttgtnaaaacctgaacccagaaacaacacaatccgntgcaaacccaaaggacccaagtactttccaatctcagtcactctaggactctgnactgaatggctgacctgacctgatgtccattcatcccaccctctcacagttcggacttttctcccctctctttctaanagacctgaactgggcagactgcaaaat

SEQ ID NO: 13402 - DNA, 177 bp, Homo sapiens
  misc_feature 8, 18, 133, 149, 167: n = A,T,C or G
gttttacnacagaagaanccttaagacacccgtggcttcaggatgaagacatgaagagaaagtttcaagatcttctgtctgaggaaaatgaatccacagctctaccccaggttctagcccagccttctactantcgaaagcggccccgngaaggggaagccgagggngccgagacca

SEQ ID NO: 13403 - DNA, 326 bp, Homo sapiens
  misc_feature 31, 38, 68, 125, 171, 180, 225, 285, 319: n = A,T,C or G
cagggtctcactctgttgcccaggctggagngcagtgnggtattacagctcactgcagccttgacttncctcagctcaggtgatcctcccacctcagccttccgagtagctgggactacaggtgngcaccaccatgcccagctaatttctatagatggggtttcgctgagntgcccaggntggtcttgaactcccgtactgaagcaatctgcccacctcagcctnccaaagtgctgggactataggcccaccacaccacgcctggcggctttgcacgttcttggnatcttatacaactggtaacatactacatgtgatnttctgag

SEQ ID NO: 13404 - DNA, 325 bp, Homo sapiens
ttcggcacgagagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtat

SEQ ID NO: 13405 - DNA, 358 bp, Homo sapiens
agcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgt

SEQ ID NO: 13406 - DNA, 104 bp, Homo sapiens
agtacttctagagcggccgcgggcccatcgattttccacccgggtggggtaccaggtaagtgtacccaattcgccctatagtgagtcgtattacaatttcactg

SEQ ID NO: 13407 - DNA, 321 bp, Homo sapiens
  misc_feature 39, 104, 178, 249, 272, 303: n = A,T,C or G
cagcaatgtccagcggcagcagatccggcagaccttcangtctcactttggccgggacttaatgactgacctgaagtctgagatctctggagacctggcaaggntgattctggggctcatgatgccaccggcccattacgatgccaagcagttgaagaaggccatggagggagccggnacagatgaaaaggctcttattgaaatcctggccactcggaccaatgctgaaatccgggccatcaatgaggnctataaggaggactatcacaagnccctggaggatgctctgagctcagacacatntggccacttcaggaggat

SEQ ID NO: 13408 - DNA, 158 bp, Homo sapiens
  misc_feature 18, 86, 100, 121: n = A,T,C or G
actccctgtaaaaattanacagacacttgaaattttaatacgttctcattaattaagaacatataaaagtggtataaaaatttgangggcaaggtgcagnggctaacgcctataatcccancactttgagaggctgaggtgggaggatcgcttgaggc

SEQ ID NO: 13409 - DNA, 116 bp, Homo sapiens
  misc_feature 32, 94, 108, 111: n = A,T,C or G
ttcggcacgaggagtacttctagagcggccgngggcccatcgattttccacccgggtggggtaccaggtaagtgtacccaattcgccctatagngagtcgtattacgnttncactg

SEQ ID NO: 13410 - DNA, 312 bp, Homo sapiens
gttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgt

SEQ ID NO: 13411 - DNA, 189 bp, Homo sapiens
acgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctat

SEQ ID NO: 13412 - DNA, 328 bp, Homo sapiens
ttcggcacgaggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctg

SEQ ID NO: 13413 - DNA, 337 bp, Homo sapiens
gttggtcagactggtctcgaactcctgacctcatgatccgcctgcctgggccttgcaaagtgctgggattacaagcatgaaccactgtgcccagccatgagttttctttttaaagtgaataagagatcaaagtgcaggaactgctaagaagacacagtaaaatggagaggaacataggcaaaactaggtggttttcctcattgaattttataaacatagtgtggtttgtttattggtcattcatgtggcatgtttctcattttgtatcttttaatgtgcataactactaataggtaatgtttattgagtacttacgatatgccagttttggtgcttt

SEQ ID NO: 13414 - DNA, 120 bp, Homo sapiens
  misc_feature 54, 75, 97, 99, 106: n = A,T,C or G
taaggatgggcattttgccctggaggagctggcccaagctggctatgaggtggntgggcttgactggacagaggncccaaagaaagcccgggagtgngnggggaanacggtgacattgca

SEQ ID NO: 13415 - DNA, 155 bp, Homo sapiens
  misc_feature 58, 125: n = A,T,C or G
agtgtacagaatttttttttaattgaagtcaatcactaaaaaaattagaaggcagggnctatttacacaattaagctgaagaaagcactaattttttgtagtttaaaatatatatatattttagncagatttaaaattttaagctttatagagtg

SEQ ID NO: 13416 - DNA, 210 bp, Homo sapiens
  misc_feature 3, 8, 19, 21, 23, 41, 48, 68, 109, 126, 128, 203, 210: n = A,T,C or G
gtnatcancctcggacctnangnggctgaaggagagaatgnatttggngtctgccatatctttgcatncttcaatgacacttttgtccatgtcactgatctttctggcnaagaaaccatctgccgngngactggtgggatgaaggtaaaggcagaccgagatgaatcctcaccatatgctgctatgttggctgcccaggatgnggcccan

SEQ ID NO: 13417 - DNA, 330 bp, Homo sapiens
tacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgtt

SEQ ID NO: 13418 - DNA, 335 bp, Homo sapiens
caaatgtgcatattataatgaggaatggtactaccgttccagattttctgtaattgcttctgcaaagtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactaccta

SEQ ID NO: 13419 - DNA, 335 bp, Homo sapiens
ggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaaggtgtgcatcaccttcgaccaggccaacctgaccgtcaagctgccagatggatacgaattcaagttccccaaccgc

SEQ ID NO: 13420 - DNA, 261 bp, Homo sapiens
  misc_feature 8, 20, 61, 153, 156, 168, 191, 226, 242: n = A,T,C or G
gtcactgnagcatctggggngacgggggtaagggtcacggggggaatccaaagtccagagngagggctgctgctcacagtgcccggctgcctggggaatcacctagaagccaagctggacaaaccagatgtggtgaactggatgtgctaccgnaanacagaggacttnttcaccatctggctggatctcancatgttcctaccccttggggtagactgctggatcnataacaccagggttgnctacaaccggagctctggg

SEQ ID NO: 13421 - DNA, 108 bp, Homo sapiens
gagctgactgtagtattttactattgtctgttaaaaaaagaaaaactgtaatttatatcccctttgaactttattgtgtttaattggtacacatttctgtgtgtgtgt

SEQ ID NO: 13422 - DNA, 328 bp, Homo sapiens
  misc_feature 13, 87, 152, 258, 278, 307, 315: n = A,T,C or G
cggaaatggcagngttttaggtgctgaggattcaccagtgaacaaaacagaccacaaaaccctgctcttatggagcttatatgctantggaccattaccctcttgcgctgttgcagagaacgggaaaatgggaagcagcgggcagctggcancccacaccttaccctggagttctgcaactatccttccagcatgagggaccatattgattaccgctgctgcctgcccccagcaacccaccgtcctcatcccaccagnatctgtgacaacttctcggnttatggctggggccccctgggaccacagngtcctcantctcacgatattg

SEQ ID NO: 13423 - DNA, 322 bp, Homo sapiens
ttcggcacgagtttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttgtgaattcaaaagtcaattattcaaaagcagggaaagattttga

SEQ ID NO: 13424 - DNA, 333 bp, Homo sapiens
gagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaatttttt

SEQ ID NO: 13425 - DNA, 228 bp, Homo sapiens
  misc_feature 62, 92, 126, 175, 176, 178: n = A,T,C or G
cctccatgcccagctaatttttgtatttttacaaaatacaaaacatggggtttcaccactgntggccaggatggtctcaatctcttgacctnatgatctgcctgcctcatcctcccaaagtgctgngattacaagcatgagccaccgcacccggccttgctctcttcttttatgnntngagcggtggctccatttacagagattgtctagccatatcattggattctt

SEQ ID NO: 13426 - DNA, 164 bp, Homo sapiens
  misc_feature 17, 46, 79, 94, 117, 147, 149: n = A,T,C or G
ctcgtgccgaattcggnacgaggaaaaggcctcctctgtgtgatgncccaaggagtgtaaattattacattcttcctgnggcagaaaccattanttgcccccaatatccattttctnttttccttagtaaacaattatctgactttnanccgaacacttgggct

SEQ ID NO: 13427 - DNA, 329 bp, Homo sapiens
  misc_feature 11, 79, 122, 143, 229, 231, 291, 317: n = A,T,C or G
taccgacagcntctgaaggagaaatttaataaatactgccggttaaatgatcacaagaggcccatttgtagtggctggntgacaacggctggagcaaattaaataaataaaatagctctgtntttcaatgaaacactcacgangactactgcgccttctctttcgaaaaactcttaatttagggacttatggcaaaattttatcttaaatcaatgtgattctttcttgntntgggagacggtggaggtatcctcattagttctttcttcaggcttgtgtctttagttgcgnggctgcgcaggcctgccatatgattnaagccatctctt

SEQ ID NO: 13428 - DNA, 211 bp, Homo sapiens
  misc_feature 65, 83, 136, 159, 160: n = A,T,C or G
atttgagctcttctcctatctttgccgacccccccgctctctttttaatagatttgttcgaatgnagaaagacctaaaatacntatgtatccctaaagtgacttattttatagttttctttctttttgaacttcanaaaaattgtatcatactctatgnngtctaaggatttggtttttttcactcaacatgtctctagaattcacaagtt

SEQ ID NO: 13429 - DNA, 323 bp, Homo sapiens
acgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacat

SEQ ID NO: 13430 - DNA, 323 bp, Homo sapiens
cggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttg

SEQ ID NO: 13431 - DNA, 365 bp, Homo sapiens
acgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcagg

SEQ ID NO: 13432 - DNA, 117 bp, Homo sapiens
  misc_feature 17, 63, 102: n = A,T,C or G
cgctcttcgttgcccantttccgctcagtggtcgcgtctccgccccccacccaccagtcccgntgcattctcggccgggctctaggcgccatggctccccgngggaggaagcgtaag

SEQ ID NO: 13433 - DNA, 328 bp, Homo sapiens
  misc_feature 11, 44, 77, 86, 115, 146, 200, 240, 242, 272, 308: n = A,T,C or G
gttggccgagnggagactggtgttctcaaacccggtatggtggncacctttgctccagtcaacgttacaacggaagnaaaatctgncgaaatgcaccatgaagctttgagtgaanctcttcctggggacaatgtgggcttcaatgncaagaatgtgtctgtcaaggatgttcgtcgtggcaacgttgctggtgacagcanaaatgacccaccaatggaagcagctggcttcactgctcangngattatcctgaaccatccaggccaaataancgccggctatgcccctgtattggattgccacacggntcacattgcatgcaagtttg

SEQ ID NO: 13434 - DNA, 117 bp, Homo sapiens
  misc_feature 50: n = A,T,C or G
ctcatgcctgcttccagtcactgtttcttcaaggttaactattattctgncttctgacagcatacattagttttgcccatttgtactttatataaatggaagtatacagtttctatt

SEQ ID NO: 13435 - DNA, 320 bp, Homo sapiens
ttcggcacgaggtttagcaccacacccatggtgctgttctcatgatagtgaatgagttcttgtgagatccgctcatttaaacacatttaacacctctcccatctcttccctgctccttttctggccatgtgatgtgtatgctcccctttcactttccaccatgtttgtaagtttcctgaggcttcctcagaagctgagcagatgccagcatcatgcttcctatatagcctatggaaccatgagccaattaaaccccttttctttataaattacccaatctcagatattttttatagtagtgagagaataaatagactaac

SEQ ID NO: 13436 - DNA, 353 bp, Homo sapiens
agcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgcttggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtg

SEQ ID NO: 13437 - DNA, 178 bp, Homo sapiens
  misc_feature 140, 148, 177: n = A,T,C or G
cactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacnagtgcaanaagaaggggcttgccctggaactcttggng

SEQ ID NO: 13438 - DNA, 324 bp, Homo sapiens
ccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatat

SEQ ID NO: 13439 - DNA, 127 bp, Homo sapiens
tggcagtccctgcggtcccagatagcctgaatcctgcccggagtggaagctgaagcctgcacagtgtccaccctgttcccactcccatctttcttccggacaatgaaataaagagttaccacccagc

SEQ ID NO: 13440 - DNA, 330 bp, Homo sapiens
aaatgtgaaggcatgccagagagcttcatcatcgttttggtctggaaggttaggggtaacctgagaataggaagaataaaatgaggtcttcagatgctaagcaggtccagggacatctgcctgggggttaggtttaagagctatctttcttcttgaatttctttcctatcttcccttcccttgtaagattgaagcactgaagtcattctcaaaatcagacctggtcaactggttcaaggcccatagagggccaggaagtaaaatgctcagcgttcatgtgagtatgtttaactaactccatccattctagggttgtcatttactgagtga

SEQ ID NO: 13441 - DNA, 400 bp, Homo sapiens
  misc_feature 14, 20, 27, 43, 64, 73: n = A,T,C or G
tctttttgaacaanaagccnggaagtnttgcgcgcctgcaggncgacactagtggatccaaagnaattcggtncgagcaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaaatagggacctgtatgaatggctccacgagggttcagctgtctcttacttttaaccagtgaaattgacctgcccgtgaagaggcgggcatgacaca

SEQ ID NO: 13442 - DNA, 293 bp, Homo sapiens
  misc_feature 17, 43, 212, 215, 267, 287, 293: n = A,T,C or G
gcgcgcctgcaggtcgncactagtggatccaaagaattcggtncgagcgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagcccctntgntcagccgcctgggaccaccagggtgcagcttgggttcaagggtccagcccanaagctgcatttaagggtttntgggan

SEQ ID NO: 13443 - DNA, 180 bp, Homo sapiens
  misc_feature 16, 43: n = A,T,C or G
gcgcgcctgcaggtcnacactagtggatccaaagaattcggtncgaggctagtctccgtatggcccgtgccaacgcccggctcttcggcatacgggcaaaaagagccaaggaagccgcagaacaggatgttgaaaagaaaaaataaagccctcctggggacttggaatcagtcggcagtc

SEQ ID NO: 13444 - DNA, 290 bp, Homo sapiens
aagagatttaatttcttcccagtttagtcttgggagggagtatgtgtccaggaatttatcaatttcttctagattttctagtttatttgcttagaggtgtttatagtattctctgatggtagtttgtatttctgtgggatgcgtgatgatatctcctttattgtgtctatttgattcttctctcttttcttttttattagtcttgctagtggtctatcaattttgttgatcttttcaaaaaacctgctcctggattcattgattttttgaagggatttttgtgtctctat

SEQ ID NO: 13445 - DNA, 172 bp, Homo sapiens
cagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaaga

SEQ ID NO: 13446 - DNA, 169 bp, Homo sapiens
  misc_feature 99, 114, 123: n = A,T,C or G
ctgggatgatgggcactgctatccacagtctctgccagttggttttatttggaggtttgtgggctttttttaaaaaaaaaaagtcctcaaatcaggaanaaacatcaaagactntgtcctagnggagggagtaatcctaacacccaggctggccgccagctggcacctg

SEQ ID NO: 13447 - DNA, 216 bp, Homo sapiens
  misc_feature 99, 215: n = A,T,C or G
ccaacatggtgagtcttactgttgcgggctccggggccgtcgaccatgccgctcgacctccacctccgctgggaagctgaggcgccgaacggctcccanagggtcccgggaagcgcatggtgttcaggcgcttcgtggaggttggccgggtggcctatgtctcctttggacctcatgccggaaaattggtcgcgattgtagatgttattgatcana

SEQ ID NO: 13448 - DNA, 317 bp, Homo sapiens
ccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattc

SEQ ID NO: 13449 - DNA, 294 bp, Homo sapiens
gccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccacaaaagccaaaaaatgggaga

SEQ ID NO: 13450 - DNA, 382 bp, Homo sapiens
  misc_feature 42: n = A,T,C or G
gcgcgcctgcaggtcccactagtggatccaaagaattcggtncgagggaacgtctgaggttatcaataagctcctagtccagacgccatgggtcatttcacattgcagtgaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctggg

SEQ ID NO: 13451 - DNA, 193 bp, Homo sapiens
  misc_feature 22, 143: n = A,T,C or G
gaaaagacttggaagctgggtngttttttgttctggcccctcagtttgttgagagcctattttaaagatttccggtggatttaacaaaatgaacaaaatttagaggactcatttatttcccccaaccaagtcagtgccatagngggacccttacataaatttgtcactgtgtttaaatttgatgtagtgaatg

SEQ ID NO: 13452 - DNA, 151 bp, Homo sapiens
ttcggcacgagcgacgtcctaatccaactgggagaagcctcagtggtggaattccaggcactgtgactgtcaagctggcaagggccaggattgggggaatggagctggggcttagctgggaggtggtctgaagcagacagggaatgggaga

SEQ ID NO: 13453 - DNA, 269 bp, Homo sapiens
caaccactttgacatttattgatattagcaacaatagacttggaaggaaagggataaagcaagaagcatttaaagacatgtatgatctccatcatctgtacctcactgataacaacttggaccacatccctctgccactcccagaaaatctacgagcccttcacctccagaataacaacattctggaaatgcacgaagatacgttctgcaatgttaaaaatttgacttatattcgtaaggcactagaggacattcgattggatggaaac

SEQ ID NO: 13454 - DNA, 364 bp, Homo sapiens
  misc_feature 1: n = A,T,C or G
nagaagatgatccatatattccctgaaggcatgagatggctgtccagggctcggaggaaaaataatgttaattacagtcagtctcaatgtgctgtttgctgctttaaagttttaggcctgttttccttgagcttgacatctgcttaaccagcccattggcaaactcctgagttctcagaaaaagatacaaaggactgccgaggctctcaccagcccttgctcgttctctgtctccctgtctccggatgcttctgtgagtctctgtttcagcctacatgccacctgccctagccgacatttgttctcctctgcaaccccagggaagggaccctcactcctccacaggctgcccagccccagattg

SEQ ID NO: 13455 - DNA, 228 bp, Homo sapiens
ccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttc

SEQ ID NO: 13456 - DNA, 272 bp, Homo sapiens
ctttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtacttggcctcccgggagccactgtgaccaggcctttgagctcttgtcatctgtggagagaatcatgcaaattttaaaagttcttccaagagacttccatgtcctggttattaacaaaaaaggaaaaatg

SEQ ID NO: 13457 - DNA, 208 bp, Homo sapiens
ggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgtt

SEQ ID NO: 13458 - DNA, 245 bp, Homo sapiens
  misc_feature 16, 23, 176, 208, 213: n = A,T,C or G
tcgtgccggaatttanggagccnaagatggctagaattttcagggcagaatttggaaaagagagagagccatgcttagcaaaaatctcaaaaatcagtatgggagactcctggagtcctttacctaatactaatctgcatatatgtatgataaaaattgataagaccatgtgaaantaacaaattctacagaaagaaatattactatngagtngggagcttgagtatttgctaagctcccacagg

SEQ ID NO: 13459 - DNA, 216 bp, Homo sapiens
  misc_feature 64, 126, 193, 205: n = A,T,C or G
ttcggcacgaggacagctggtgcgcctgcccgggaacatcctcctggactcaatcatggcttgnggtctggtcgccagcaacctgaatctcaaacctggagagtgccttcgagtgcgaggcgaggnggctcctgacgctaagagcttcgtgctgaacctgggcaaagacagcaacaacctgtgcctgcacttnaaccctcgcttnaacgcccacgg

SEQ ID NO: 13460 - DNA, 201 bp, Homo sapiens
  misc_feature 10, 11, 160: n = A,T,C or G
ttcggcacgnncattatttctcaaaacaatttctgaaagcagttgtggttgcagtgagttttgtccagctttatgactatggaacaagtaagattcttcctttatgtgtgtacaccatttacctttaagataaaatcatgtccatgaggccaggtgtggnggctcactcctgtaatcctagcactttgggaggctgaggtg

SEQ ID NO: 13461 - DNA, 260 bp, Homo sapiens
gcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccat

SEQ ID NO: 13462 - DNA, 159 bp, Homo sapiens
ctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctga

SEQ ID NO: 13463 - DNA, 208 bp, Homo sapiens
  misc_feature 21, 130, 133, 150, 203: n = A,T,C or G
attttttacttttttttatgntcaaggaaaagatcattaaaaaaaaacacaaagaagtttttctttgtgtttggatcaaaaagaaactttgtttttccgcaattgaaggttgtatgtaaatctgctttgnggngacctgatgtaaacagngtcttcttaaaatcaaatgtaaatcaattacagattaaaaaaaaaagcctgtntttaa

SEQ ID NO: 13464 - DNA, 268 bp, Homo sapiens
  misc_feature 22, 259: n = A,T,C or G
ctgggtagagccagcaaagganacctcaaaaggatggcagacagggtgaggtaaggtcaggaatgtgtgctgtggcattactgaaacctaaagagaaaaaaatcgtgtttcaggaagaaatcaacttataaatgctgaggaagaaaggctagtagtgattattatttctcattacctaagcatttgagtcatttctgttattgtctgagaagctggagacacaaaaataggatttgtaggtagcttagggcctagtcanaacctctat

SEQ ID NO: 13465 - DNA, 314 bp, Homo sapiens
  misc_feature 22: n = A,T,C or G
acgatttgtaaagctcctcacntgattataaggagcggccagagttgcaatcattgctctaatgtgaaagcctcaaatgaaagttattgtattagtccgttttcacactgttgataaagacaaacccgagactgggcaatttacaaaagaaagaggtgtaactggacttacagttccacgttgctggggaagcctcacaaccatggcagaaggcatggaggagcaagtcccgtcttacatgaatggcagcaggcaaagagaaaatgaggaagatgtaaaagtggaaacccctgataaaaccatcaggggtgaga

SEQ ID NO: 13466 - DNA, 292 bp, Homo sapiens
  misc_feature 170: n = A,T,C or G
ggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtanaagattcaagggccagatcttgatgcccaacattggttatggaagcaacaaaaaaacaaagcacatgctgcccagtggcttccggaagttcctggtccacaacgtcaaggagcttggaagtg

SEQ ID NO: 13467 - DNA, 289 bp, Homo sapiens
  misc_feature 46, 201, 277: n = A,T,C or G
gattaagacaaagaacatatccaatcaacagaaaatataccttggngccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggngtggctaagatggaaacagggctgattcttgattcccaattctcaactctccttttcctatttgaatttctttggngctgtagaaaac

SEQ ID NO: 13468 - DNA, 339 bp, Homo sapiens
  misc_feature 21, 23, 104, 324: n = A,T,C or G
ctgtatttgggttttaaagtncnggtacctaacaagatgcaatgctatataagtagtagacactcaaatatttgatgaattaaatagggtgttccatttttggnggttgcatgagttccgtgcacttggagaaaacatagtagatacacactactggtttcattgtccaagaaaacagtcttctattgcaatatttataattttccatgtcattctcatcttttgtaatcacaaatatttacattttagatgctaacattaatcataaataacagcaagacctcttacttactttcacacttaaatttcatccctctaggaaanaaaattattggagtg

SEQ ID NO: 13469 - DNA, 376 bp, Homo sapiens
  misc_feature 21, 349: n = A,T,C or G
cccgaatgccagagaaggtcncatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggagggaagagaccaagaaataaaacctcccacttttgnctgtacatactggccctctgtgattac

SEQ ID NO: 13470 - DNA, 132 bp, Homo sapiens
  misc_feature 21: n = A,T,C or G
ttcattttgatttattttaantctttacattcagaaatgagatactgtattatcagaccaggaggcattgctgtgaaagataatttcctattctaaaatatcaaatttaaaataaagataatgaaagaaaac

SEQ ID NO: 13471 - DNA, 223 bp, Homo sapiens
  misc_feature 48: n = A,T,C or G
ccaaacccctccccaccctttttttttggttttaaatcactgtacagngttatttgatattttaatttattttttgattgactagaaaaatcattttaatttcactaaaatgttttttgtccctaaggaaaagtaatctgtaaaaataattttaattagcataatacagtcacctagacacttccatttgtaatctttgtaatagactgtaaatatatttttg

SEQ ID NO: 13472 - DNA, 352 bp, Homo sapiens
gcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggcctacaaaccaccctctcctgaccctgaagaactgtgtgattctgccccacattggcagtgccaccccacagaacccgcaacaccatgtccttgttggcagctaacaacttgctggctggcctgagaggggagccgatgcctagtg

SEQ ID NO: 13473 - DNA, 137 bp, Homo sapiens
gtccacggccaacatgctcagggaacaggtggcacagcttaaacagaaagtcatgaaccacgttaacagtgggtgccaactcatgctaacgcagcagttgcaaacattttgaagagagaccgtcgggggctgagggg

SEQ ID NO: 13474 - DNA, 245 bp, Homo sapiens
  misc_feature 20, 28, 51, 147, 204, 228, 231, 244: n = A,T,C or G
ctcagggcaagctctgagtnctctaggnggatttgcttcacattctttggngaaacctctgtgcatatcaaaatcttttgcaagacaccattcactgttccttcagatacatagttcagtgatgaatgttgaccattcctccacttncatgtgcatatttgtaacaaactcagatctccaacctctaaaataacaaatataggnttgcaaattttcaatttttttttnggntttttttttggana

SEQ ID NO: 13475 - DNA, 333 bp, Homo sapiens
gtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactat

SEQ ID NO: 13476 - DNA, 346 bp, Homo sapiens
  misc_feature 20: n = A,T,C or G
gcaagaagcagctggagacngacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatg

SEQ ID NO: 13477 - DNA, 173 bp, Homo sapiens
  misc_feature 64, 169: n = A,T,C or G
gtgacttccatctcttccagaaggaattaaacccatgtgggaggatgatgcaaataaaaatggnggcaagtggattattcggctgcggaagggcttggcctcccgttgctgggagaatctcattttggccatgctgggggaacagttcatggttggggaggagatctgngggg

SEQ ID NO: 13478 - DNA, 400 bp, Homo sapiens
  misc_feature 15, 18, 173, 175, 397: n = A,T,C or G
cttagcctacataanaancccaaaggggttggcatctgccatccctctgaagaaggggcagtgtgtagtgaacctgaggctccttagtgaagcactgttctggcttgagcttctgccacaatccaactagaaaagcattaggttgtttatttatttccaccctaggtgtcccngncactaccaggttgcacgatatttgtcagcaggtgacactaatgggccttttggccatatcctttcctttggctcccttgtctttcattccagcagtacacatctcttgcttatgcagcttctctgtttcccctaagttggaagccgcttgggccacctgagacattggctgtcttatcaaggggctcaggatacacactactgggatacaccactggctganggc

SEQ ID NO: 13479 - DNA, 353 bp, Homo sapiens
  misc_feature 25: n = A,T,C or G
tcgagccttgctgcattcttcatanatcatttaagctagctatttaaaaagaaaaaagaaagttagttgtagaaaccactggttttatttcctttcaaattaaattttatgaggaagtcagtatgtagaactgataaaaatcagagttgttctagatgaaaagagatagagccacagtcccatcttttaagcctctcctagggatccctggaatacttgatgagaaagccttagcctaatacccccacaccccagaaaatggggcctagtgcaactcttcagtttccccatctgggacttgaaggttttgtttatcttgtgcttggcgatgttattatgtggaattcacagga

SEQ ID NO: 13480 - DNA, 347 bp, Homo sapiens
  misc_feature 22, 137, 148: n = A,T,C or G
gagatgacgaagggaacgtccncgtttggaaagcgtcgcaataagacgcacacgttgtgccgccgctgtggctctaaggcctaccaccttcagaagtcgacctgtggcaaatgtggctaccctgccaagcgcaaganaaagtataacntggagtgccaaggctaaaagacgaaataccaccggaactggtcgaatgaggcacctaaaaattgtataccgcagattcaggcatggattccgtgaaggaacaacacctaaacccaagagggcagcttgttgcagcatccagttcatcttaagaatgtcaacgattagtcatgcaataaatgttctgggttttaaaaaat

SEQ ID NO: 13481 - DNA, 232 bp, Homo sapiens
  misc_feature 19, 98: n = A,T,C or G
gtaaaaagtgctgaaaaanaaatcagcctatggtttaagcctgaagaactggttgactacaagtcttgtgctcatgactgggtctatgaataagaggnggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 13482 - DNA, 337 bp, Homo sapiens
tgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtg

SEQ ID NO: 13483 - DNA, 292 bp, Homo sapiens
  misc_feature 20: n = A,T,C or G
gaaggctgctggagctggcnaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatg

SEQ ID NO: 13484 - DNA, 260 bp, Homo sapiens
ccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagg

SEQ ID NO: 13485 - DNA, 120 bp, Homo sapiens
gtcccagctactcgggaggctgaggcaggacaattgcttgaacctgggaggcggaggttgcagtgagccaagatcgccaagatcatgccactgcattccaacctgagcaacagagtgaga

SEQ ID NO: 13486 - DNA, 396 bp, Homo sapiens
aaaaaataagacaatcttccacacttttgataaaccatttttattcccattttatagacaaggagactaggactcaaagtgctgtggactgagtgtgctcccctcaaattcactgtcgaaatcctaacccacaatgtggtggtattaggaggtggaatatttagtgggtagttaagtcctaagggtggagcccacatgaaagggatagagtccttataaaagagaccccagagagctccctcaccctgttcctccatgcagggacacagtgaaaaggcaaatgtctgtgaaccaagaagcaagacactgaatctgccagagccttgatccagcacttttcaacatccagaactgtgagcaataaacttttgttgtttctaagccactctgcctatg

SEQ ID NO: 13487 - DNA, 338 bp, Homo sapiens
ctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaaga

SEQ ID NO: 13488 - DNA, 396 bp, Homo sapiens
  misc_feature 20: n = A,T,C or G
tttgatttgaaccaaaaccngaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactca

SEQ ID NO: 13489 - DNA, 120 bp, Homo sapiens
tggacatgtcagcatgttaagtaaaaggagaatttatgaaatagtaatgcaattctgatatcttctttctaaaattcaagagtgcaattttgtttcaaatacagtatattgtctattttt

SEQ ID NO: 13490 - DNA, 353 bp, Homo sapiens
  misc_feature 72, 345: n = A,T,C or G
ctgcggtggagccgccacccaaatgcagattttcgtgaaaacccttacggggaagaccatcaccctcgaggntgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggnggatgaga

SEQ ID NO: 13491 - DNA, 306 bp, Homo sapiens
  misc_feature 173: n = A,T,C or G
gtggtgttggagccgctgcccttgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgnaaaaaccccgctagaaactgcagagacctgaaattctgccatcctgaactcaagagtggagaatactgggttgaccctaaccaaggatgcaaattggatgctatcaaggtattctgtaatatggaaactgggg

SEQ ID NO: 13492 - DNA, 400 bp, Homo sapiens
  misc_feature 17, 45: n = A,T,C or G
gcgcgcctgcaggtcgncactagtggatccaaagaattcggtttngagcattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttgaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagc

SEQ ID NO: 13493 - DNA, 400 bp, Homo sapiens
  misc_feature 16, 35: n = A,T,C or G
gcgcgcctgcaggtcnccactagtggatccaaagnaattcggttcgagatgaaatgcaaacattatacattttaatcagtgacttggtttgttctaagtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagca

SEQ ID NO: 13494 - DNA, 277 bp, Homo sapiens
  misc_feature 21: n = A,T,C or G
actgtttgttcccacttatgngagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctggga

SEQ ID NO: 13495 - DNA, 294 bp, Homo sapiens
  misc_feature 148, 153, 200, 220, 237, 258: n = A,T,C or G
cacacctgtaatcccagctacttgggaggctgaggcagaagaatttcttgaacctgggaagcggaggttgcagtgagccaagattgccactgcattccagcctgggtgacagagcaagactgttccccctccaccaaaaaaaaaagtntgganaaggatttggaggcaacaaggctacaacccaaaaatgggataatggnggcttgcactaggttagtancactagaaatggaaaanaaaaaatagacttgaggtatntttttggaggtaaactccacggagttggatagactg

SEQ ID NO: 13496 - DNA, 332 bp, Homo sapiens
  misc_feature 45, 180, 216, 303: n = A,T,C or G
gtctcgagttttttttttcaaaccaccccggacagcccccagctntgattccttcaaggcccggcctgtccgggccaccattccacaccttgcggtttgaaacagctgtttttcccacatttgctgcaggcatggctgtctcctgcccctgcctgcccatctggcctataccccagccgnggggcccggggtccctgccgcagccccctccccttntgatgccttaaaagctgggccccaggccctgctggccagagccacagatgccaagctctgggagcttgactatggaccaaacagctntggcctagggattgggccaccctacccag

SEQ ID NO: 13497 - DNA, 167 bp, Homo sapiens
  misc_feature 42, 86, 92, 110, 116: n = A,T,C or G
gtgaaatccatctgggacaaaaaaaaaattttttttaattanctgggcgtggtggtgtgtgcccgtagtcctagcaggctacaggngagctntgattagcaggttacagngagctntaattgcaccactgcactccagcctgggtgacagagctaagaccctgtctc

SEQ ID NO: 13498 - DNA, 314 bp, Homo sapiens
ggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccc

SEQ ID NO: 13499 - DNA, 198 bp, Homo sapiens
  misc_feature 78: n = A,T,C or G
taaagatagagcaaatatataattttggaggagttggagcaaaggaactgtgggccgaaattgtcctttatctatggnggtttagcttgcaagtaaatagtgttaaaaatagtccttgtttgaggtactggaattgaggtacttaacactttctcagggcatttgtatctccggattgtgttttttttgtgtgtgaga

SEQ ID NO: 13500 - DNA, 389 bp, Homo sapiens
  misc_feature 20, 214: n = A,T,C or G
caacatggtgttcaggcgcntcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccanaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaaga

SEQ ID NO: 13501 - DNA, 248 bp, Homo sapiens
  misc_feature 176: n = A,T,C or G
cagatttggtggtggtattccccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgnggctaaaaaatagtcgaacctttcttgagaactctgtaacaaagtatgtttttgattaaaagagaaagccaa

SEQ ID NO: 13502 - DNA, 332 bp, Homo sapiens
  misc_feature 22: n = A,T,C or G
ccttacgaaaggcggcaaaaanggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcaga

SEQ ID NO: 13503 - DNA, 162 bp, Homo sapiens
ccgaaggccctgcgggcctgccttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatg

SEQ ID NO: 13504 - DNA, 314 bp, Homo sapiens
  misc_feature 9: n = A,T,C or G
ttcggcacnaggtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatg

SEQ ID NO: 13505 - DNA, 389 bp, Homo sapiens
  misc_feature 22: n = A,T,C or G
tccatgctgagattgaagtatnggccgcccgtccagagggatttcctgactcagaggaagtgatgcccatggaatcctatattgcagaagacctaacactaccaaactgaaatcttctgtttgggttcacacttcagctcaactattctgtggctgtcagtgagaccaccaccaaaggctaaacctgtgggccacaacacatatccaatctcagattagtctcagcacattgcttcctctccagtttgaaaaacacatagaaaatcacttccagtttccaaagtgaaaattcataacatttatcattcaagcaattgtataatgtgctttattctcgaaaataaatcttcaggatgcatttttaaatatataattccaaacaaattatt

SEQ ID NO: 13506 - DNA, 341 bp, Homo sapiens
gcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataagg

SEQ ID NO: 13507 - DNA, 396 bp, Homo sapiens
  misc_feature 21, 74, 101, 134: n = A,T,C or G
gaaaaatggaccctttaaaanttatttttacctgaagcttgtcataatttttttaaagcaaatatatatatggngatggtacttttcaaagtgtgtattangtggtgatcacctcaaacataaacctctgttgngaatcatttgtgtccttttcaactgtctttcagaggaaaggtaaaaaatcattaaacctgaaattcattgttaaaatcaaatatttgtcagcagtaactcaagctcatggttctcaagcagaaaaaggtttgggagactaaaaatggagtcaggttgtcatggagactgctaactccttggggtagacatgggccttgcctcagcaaaccagtgcaatttcccaatgtcttagtttcagaattcatgctgatttcattatgg

SEQ ID NO: 13508 - DNA, 341 bp, Homo sapiens
accttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 13509 - DNA, 191 bp, Homo sapiens
  misc_feature 2, 17, 35, 42, 44, 160: n = A,T,C or G
gngcgcctgcaggtccncactagtggatccaaagnaattcgntncgagaaagtaaggcatccatcatctgtagcatttctcctttgttttacaaacaatccaattctacactttaaaaaaaaatttttaaatgtacaattaaatttttatttaccacagngttatttttatcgtcataataaaaattatat

SEQ ID NO: 13510 - DNA, 350 bp, Homo sapiens
gcgcggaggcggaggcttggctgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagagg

SEQ ID NO: 13511 - DNA, 360 bp, Homo sapiens
gtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtga

SEQ ID NO: 13512 - DNA, 386 bp, Homo sapiens
ccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctg

SEQ ID NO: 13513 - DNA, 385 bp, Homo sapiens
  misc_feature 22, 218: n = A,T,C or G
gcaaatcaaagatttttaggcncagctcaactgtccactgtcctatccttagcttcacagatggctctgaattttattctagaattccctcttcgcccaccccttcccccactataacccaaggcaggtcatttcttattttaggattcagcttttattcttttgctctgagtcccaggttccaaaatgcaattgaaaacacctttttttttctaagngcaaaatgattgttaatgtatgctgaatgtccagcacctgacacagctaggcctgtgcttgcctggaggcttgcaggctagccaggaaagggaatgttaaacttacattgaagaagagcccaccagccttgaaacccactaactccagaggggggtcatttataaag

SEQ ID NO: 13514 - DNA, 324 bp, Homo sapiens
  misc_feature 20: n = A,T,C or G
aaaaaaagaggctccgggtncacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcgg

SEQ ID NO: 13515 - DNA, 249 bp, Homo sapiens
gtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtg

SEQ ID NO: 13516 - DNA, 357 bp, Homo sapiens
  misc_feature 339: n = A,T,C or G
ccagcactaaaacatcctccgaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtaagttcggtagagtcctaaaatttttgnactactttcaatttgggg

SEQ ID NO: 13517 - DNA, 343 bp, Homo sapiens
caaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagca

SEQ ID NO: 13518 - DNA, 255 bp, Homo sapiens
  misc_feature 2, 4, 31: n = A,T,C or G
gngncactagtggatccaaagaattcggttngagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgc

SEQ ID NO: 13519 - DNA, 396 bp, Homo sapiens
  misc_feature 1, 58, 60: n = A,T,C or G
nacaaaaagccggattttgcgcgcctgcaggtcccactagtggatccaaagaattcgntncgagtcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatct

SEQ ID NO: 13520 - DNA, 278 bp, Homo sapiens
atcccaccctgccccctctcctgccaccccatggtcttcacccagatgtctcctcctctcccctaggtcttcctgtccatcaaaggcatttactaccaggccgaggtactggggcagcccatcgtgtggatcactccctatgccttctcccatgacgtgagtgtgcctgtcgggaggggacgggcttgtgctgcctcctagacagatatggatgtggaggaagggggattttgctgtccatggagtttagcaagtgctgggttcccaactgttgatga

SEQ ID NO: 13521 - DNA, 372 bp, Homo sapiens
  misc_feature 16, 359: n = A,T,C or G
gcgcgcctgcaggtcnccactagtggatccaaagaattcggttcgagtcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctntgcttcccttttg

SEQ ID NO: 13522 - DNA, 395 bp, Homo sapiens
  misc_feature 4, 22, 48, 74: n = A,T,C or G
attnttgcgcgcctgcaggtcnccactagtggatccaaagaattcggntcgagggaagtttagagggatgaggnggcaggagaggtgaacagttgcaggacgtagctagagtggcaatgttagatcttgggaccagagagctttacaatgagtatgaagatcaaagggcattagaatcaagctataaagagctactgtttgatgttggtatgtaagtatgctgcaggtggatgtctgcacattgatggtgagaaagtggtcaccctggccctgctgggtctttgctaaagagactgtgctctgttcttggggccgttttcatcacctgattacagcagtggtccccaaatggtgttctttggaccatctgtataaaatgttcataggtcaaggat

SEQ ID NO: 13523 - DNA, 400 bp, Homo sapiens
  misc_feature 42: n = A,T,C or G
gcgcgcctgcaggtcccactagtggatccaaagaattcggtncgagctcgtgccgtacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagca

SEQ ID NO: 13524 - DNA, 398 bp, Homo sapiens
  misc_feature 43: n = A,T,C or G
gcgcgcctgcaggtccacactagtggatccaaagaattcggtncgagcgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttca

SEQ ID NO: 13525 - DNA, 220 bp, Homo sapiens
  misc_feature 2, 6: n = A,T,C or G
tngagnagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagc

SEQ ID NO: 13526 - DNA, 163 bp, Homo sapiens
ctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaa

SEQ ID NO: 13527 - DNA, 289 bp, Homo sapiens
  misc_feature 31, 45, 54, 78: n = A,T,C or G
gagaaatcacggccgagaggtcggtggcggnggctcaggcctgtnatcccagcnctttcggaggcctgggcagtcggntcaccagaggtcaggagtccaagattagcctggccaacatggtgaaactgttgtctctactaaaaatacaacattatgccaggcgtgatgggcacctgtaatcccagttcctccagagattgaagcaggagaatcgcttaaacctgggaggtggaggttgcagtgagtggagattgcctgggaggtggaggttgcagtgagtggagattgc

SEQ ID NO: 13528 - DNA, 260 bp, Homo sapiens
ctcgtgccgccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaaacct

SEQ ID NO: 13529 - DNA, 272 bp, Homo sapiens
  misc_feature 249, 271: n = A,T,C or G
cccagccgtacctattcgtccacggtgccccgtagcagcaggtcctgcagccaaatctgtctcccttcatgggcctcccagggaaggaggaagccctgctgtgcagacacctctgtggccccccaggggtgtgagcggcctggggagggggccgtggcacttgaggccgaaagtgcctgccagacggcacggtctgggtgcggggtgttccctgtgagcccgagtccgcttcaggaggggagcctgcangttcccggctggtgaggggatna

SEQ ID NO: 13530 - DNA, 327 bp, Homo sapiens
  misc_feature 2, 221: n = A,T,C or G
cngtttgggggtacctgaaaatactaaaaatagagctaccatatgatctagcaatcctatagcttggaatacacccaaaaggaagaaaatcagtgtatcaaagataaatctatactttcatgtttgttgcaacacctgttcataataactaagatttgaaagtcacttaagtgtccataactagatgaatggataaagaaaatgtggtatatatacacagnggagtactactcagccataaaaataagaatgatatccagtcgtttgcaacaacatggttggaactagagatcattatgtttgtgaaataagccaggcacagaaaga

SEQ ID NO: 13531 - DNA, 276 bp, Homo sapiens
ccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 13532 - DNA, 127 bp, Homo sapiens
  misc_feature 21: n = A,T,C or G
gtcaaaggcaggaaaggtaanccatggtcctcaaaccaaagagccctctctgtaggtcctctgatctttgagtgtgagctcaagctctccagtggacacagaaaaaggcctggtagtaagtggtttg

SEQ ID NO: 13533 - DNA, 259 bp, Homo sapiens
cacctgaaataggaatccggccgaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccat

SEQ ID NO: 13534 - DNA, 281 bp, Homo sapiens
  misc_feature 20: n = A,T,C or G
gggacagttacttaactcangaaaagcaacctagctccaagtttagcaaccgggagttccagttgattccattagcgcaccccctgaggcattcccaagctggagtctggtggaagatgaggctcagtgtgattggactgaagcaccaacctatcaaggagaagtcccacccagtctgccctgtgcctatataaaggcgacaagtggcggccgcagcactcattgaagccgccagttgggagaggagcagagccaggccggtgctcccgaaggcagcaaga

SEQ ID NO: 13535 - DNA, 398 bp, Homo sapiens
  misc_feature 16, 42: n = A,T,C or G
cgcgcctgcaggtcgncactagtggatccaaagaattcggtngagcggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccact

SEQ ID NO: 13536 - DNA, 325 bp, Homo sapiens
ttcggcacgaggaacagtgctacttactgatgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggcgtgctgttgcaaagttttcacgtcattgtttcctggctagttcatttcattaagtggctacatcctaacatatgcatttggtcaaggttgcagaagaggactgaagattgactgccaagctagtttgg

SEQ ID NO: 13537 - DNA, 334 bp, Homo sapiens
ttcggcacgagcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttac

SEQ ID NO: 13538 - DNA, 280 bp, Homo sapiens
  misc_feature 20, 173: n = A,T,C or G
caagctagatgcttaagaantgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagnggagcttgcctccagttcaattcacaagagcattttccctcccatgcccaccttttcttgtggctgtcgctaggaaggatgcagaggctgtgtggtttaccaaatgc

SEQ ID NO: 13539 - DNA, 311 bp, Homo sapiens
gcaaagcaggggaaggtctcggcagcgccgaggtgtggccgagagggttgtgctctgcaccatgctgggatgcagaatggaggcctgtgccgcccagatggactcagcctgcacagccgtgacccctgactgcatctgggtagcttcgatccacgcacatgtggcgggcacagtgaggctgccacctggtcagacctcggggctgaccctgcctgacagcatgtgtgaaatccctctttaagatgggcctcctccgaggagctgtgaggggtgagggtgaaatccctccttaagacgagcctcctctgagg

SEQ ID NO: 13540 - DNA, 354 bp, Homo sapiens
  misc_feature 17, 35, 43: n = A,T,C or G
gcgcgcctgcaggtcgncactagtggatccaaagnaattcggntcgaggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctg

SEQ ID NO: 13541 - DNA, 340 bp, Homo sapiens
  misc_feature 42, 330: n = A,T,C or G
gcgcgcctgcaggtcgacactagtggatccaagaattcggtncgagcgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaanagatcaaaga

SEQ ID NO: 13542 - DNA, 331 bp, Homo sapiens
  misc_feature 41, 43, 179: n = A,T,C or G
cgcgcgcctgcaggtcgacactagtggatccaaagaattcntnacgagccaaagtggtgatcgagtttaacaaggaccagctggaggagttcaaggaggccttcgagctgtttgaccgagtgggggatggcaagatcctgtacagccagtgtggggacgtgatgagggccctgggccanaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggg

SEQ ID NO: 13543 - DNA, 397 bp, Homo sapiens
  misc_feature 43: n = A,T,C or G
gcgcgcctgcaggtcgccactagtggatccaaagaattcggtncgaggatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcag

SEQ ID NO: 13544 - DNA, 400 bp, Homo sapiens
  misc_feature 42: n = A,T,C or G
gcgcgcctgcaggtcgacactagtggatccaaagaattcggntcgagcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaactggccgag

SEQ ID NO: 13545 - DNA, 345 bp, Homo sapiens
  misc_feature 9, 13, 40: n = A,T,C or G
acctgcagngcgncactagtggatccaaagaattcggttngagcagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtga

SEQ ID NO: 13546 - DNA, 400 bp, Homo sapiens
  misc_feature 42, 220: n = A,T,C or G
gcgcgcctgcaggtcgacactagtggatccaaagaattcggntcgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcngcagaagcagaaaaaggcaaacgagaagaaggaggaacccaagtagcttttgtggcttcgtgtcaaaccctcttgcccttcgcctgtgtgcctggagccagtcccaccacgctcgcgtttcctcctgtaggtgctcacaggtccccagcaccgatggcattcccttttgccctgagtctg

SEQ ID NO: 13547 - DNA, 257 bp, Homo sapiens
gtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacc

SEQ ID NO: 13548 - DNA, 334 bp, Homo sapiens
ctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaaagggacctcgaatgtgggaccccagcccctctccagctcgaaatccctccacagccacggggacaccctgcacctattcccacgggacaggctggac

SEQ ID NO: 13549 - DNA, 313 bp, Homo sapiens
gtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactg

SEQ ID NO: 13550 - DNA, 136 bp, Homo sapiens
ataaagttggaacagatatgctggaggagcagatcactgcttttgaggactatgtgcagtccatggatgtggctgctttcaacaagatctaaaatccatcctggatcatggcatttaaataaaagattgaaagatt

SEQ ID NO: 13551 - DNA, 335 bp, Homo sapiens
gaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgacccta

SEQ ID NO: 13552 - DNA, 335 bp, Homo sapiens
gcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagcttggaagtgctgctgatgtgcaacaaatcttactgtgccgagatcgctcacaatgtttc

SEQ ID NO: 13553 - DNA, 131 bp, Homo sapiens
  misc_feature 21, 115: n = A,T,C or G
gcgagagtgaccgcggctgcnccagcgctgacgccgagccatggcggacgaggagcttgaggcgctgaggagacagaggctggccgagctgcaggccaaacacggggatcctggngatgcggcccaacagg

SEQ ID NO: 13554 - DNA, 332 bp, Homo sapiens
  misc_feature 327: n = A,T,C or G
gttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcnggaac

SEQ ID NO: 13555 - DNA, 271 bp, Homo sapiens
ctgtggtggaggttttcagctcatcccttggcctgaattggaaaggatgagcctcagtgccatcacccatgatgaataccctggagacattcttgcctctgctgtcctctctagatctgtggagggccagagcgtgacacttgatcccctgtaaaggctcttattgatccctttgccacctcctcccagctgtgtgtcctggggcctgctcaagaagctggaatgtgaggacagctgctaccattcccttcctagggcatgtcccaaaggc

SEQ ID NO: 13556 - DNA, 327 bp, Homo sapiens
  misc_feature 324: n = A,T,C or G
ttcggcacgaggctgcgggatgaaccgaacgccgggttaaggcgcccgatgccgacgctcatcagaccccagaaaaggtgttggttgatatagacagcaggacggtggccatggaagtcggaatccgctaaggagtgtgtaacaactcacctgccgaatcaactagccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccangga

SEQ ID NO: 13557 - DNA, 350 bp, Homo sapiens
  misc_feature 171: n = A,T,C or G
gacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgnggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggc

SEQ ID NO: 13558 - DNA, 216 bp, Homo sapiens
  misc_feature 188: n = A,T,C or G
cagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaanaaggaggcgccgcccatggagaagccgg

SEQ ID NO: 13559 - DNA, 325 bp, Homo sapiens
  misc_feature 42: n = A,T,C or G
gcgcgcctgcaggtcgacactagtggatccaaagaattcggntcgagtgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaat

SEQ ID NO: 13560 - DNA, 324 bp, Homo sapiens
cgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaagg

SEQ ID NO: 13561 - DNA, 400 bp, Homo sapiens
  misc_feature 61: n = A,T,C or G
gcgcgcctgcaggtcgccactagtggatccaaagaattcggttcgaggaagagtgctcggntagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttg

SEQ ID NO: 13562 - DNA, 352 bp, Homo sapiens
  misc_feature 299: n = A,T,C or G
ccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctntatactttggttacctatgtacctgttaccactttcaaaaatctacagacagt

SEQ ID NO: 13563 - DNA, 129 bp, Homo sapiens
caagggagggaggacatggagaaaagttctttaaacaaatagcaaactattgaacatgtgtaaaatcctgtatcatttatgaaatatgtataaaaagcaatgtaccttctggaacaataaatacttatt

SEQ ID NO: 13564 - DNA, 325 bp, Homo sapiens
ttcggcacgagttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacagaagaatatcctggggccgggcatggtggctcacgcctgtaatcccagcactttgggaggccgaggcaggtggatcataggtcaaaagatcgagaccatcctggccaatatggtgaaaccctgtctctactaaaatac

SEQ ID NO: 13565 - DNA, 256 bp, Homo sapiens
gccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaac

SEQ ID NO: 13566 - DNA, 194 bp, Homo sapiens
gaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccgggg

SEQ ID NO: 13567 - DNA, 339 bp, Homo sapiens
aaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatg

SEQ ID NO: 13568 - DNA, 356 bp, Homo sapiens
cggccttcgaggttggtggtgttaattgcagtttttacccaggcaccgcgtggttgagtaaatagccagaggtcacatgcaagcaagcgacagtgggacttggttgagcctggacatgccgaagctgcggcccacgttctctgcgctgatggtggcgtacagcagcagccagttgcacaggtgctcccattaggatctcagcccctgcacttactggatgcctgtgggccagttacctaccttctccagcctcattttcttcacccgaaactgggggcagtcccatctacctcctagggctgttgtgggtatgaagtgagaaaatcctctaatgctgatgaaagcttctggcctga

SEQ ID NO: 13569 - DNA, 340 bp, Homo sapiens
ccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcacca

SEQ ID NO: 13570 - DNA, 333 bp, Homo sapiens
cggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagattgctca

SEQ ID NO: 13571 - DNA, 321 bp, Homo sapiens
ccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaacctt

SEQ ID NO: 13572 - DNA, 399 bp, Homo sapiens
  misc_feature 41, 43: n = A,T,C or G
gcgcgcctgcaggtccacactagtggatccaaagaattcgntncgagaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttgg

SEQ ID NO: 13573 - DNA, 352 bp, Homo sapiens
gaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtgga

SEQ ID NO: 13574 - DNA, 342 bp, Homo sapiens
taaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaa

SEQ ID NO: 13575 - DNA, 321 bp, Homo sapiens
cagaagtgctttctatttcatcatttttgtttctagggctctttttctgtagccaggtcttcccaaggattttagtatttgcattggagttgaggtttactctaatgatggtggcccagctgtgcccagaggacagccagggcaggccccgggagggagtttagaaagacagtcctggtgaatgggcttcaagtggtcacaaagagggtggctgtgaggtgaccccagacactgcagaacgatgtgcaccctctgcgttttggatgtccttggaatgtgggagcctagaaataaccctgtggatggaattggggcagcggc

SEQ ID NO: 13576 - DNA, 400 bp, Homo sapiens
  misc_feature 17, 42, 43, 44, 289, 347, 360, 387: n = A,T,C or G
gcgcgcctgcaggtcgncactagtggatccaaagaaggagannntcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatnccccaaccccttcatccagcagcaggacgcctacccttggccggggccccggggggtncagggaagccccnaacagcttggtttcccggggacttggntgctgctccaccg

SEQ ID NO: 13577 - DNA, 327 bp, Homo sapiens
gccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatt

SEQ ID NO: 13578 - DNA, 170 bp, Homo sapiens
cagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgttttt

SEQ ID NO: 13579 - DNA, 327 bp, Homo sapiens
  misc_feature 14: n = A,T,C or G
accctgcagccgcnggagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcagg

SEQ ID NO: 13580 - DNA, 398 bp, Homo sapiens
  misc_feature 19, 30, 42, 45, 71, 393: n = A,T,C or G
atttttggaacaataaacnggaagttttgngcgcctgcaggncgncactagtggatccaaagaattcggtncgagggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctnctctg

SEQ ID NO: 13581 - DNA, 398 bp, Homo sapiens
  misc_feature 35: n = A,T,C or G
gcgcgcctgcaggtcgacactagtggatccaaagnaattcggctcgagtagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtcc

SEQ ID NO: 13582 - DNA, 183 bp, Homo sapiens
ttcggcacgagccagtatgactgccgagcactgaggggtcgccccgagagaagagccagggtccttcaccacccagccgctggaggaagccttctctgccagcgatctcgcagcactgtgtttacagggggggaggggaggggttccgtacgggagcaataaaggagaaactgaggtacccgg

SEQ ID NO: 13583 - DNA, 344 bp, Homo sapiens
ccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaaca

SEQ ID NO: 13584 - DNA, 283 bp, Homo sapiens
aaaaagctggagctcgcgcgcctgcaggtcgacactagtggatccaaaggaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttg

SEQ ID NO: 13585 - DNA, 377 bp, Homo sapiens
  misc_feature 42, 334, 376: n = A,T,C or G
gcgcgcctgcaggtcgacactagtggatccaaagaattcggntcgagctgggtggagcagcacctggggccccagttcgtagaacgaattatcctgacaagggacaagacggtggtcttgggggacctgctcattgatgacaaggacacagttcgaggccaggaggagaccccaagctgggagcacatcttattcacctgctgccacaatcggcacctggtcctgcccccgacaaggagacggctgctctcctggagtgacaactggagggagatcttagatagcaagcgcggagctgcgcagcgggaatgagcggggatgccgcgggcagcanctggagctaaaggaagggcaggccccacaggggccaccgaana

SEQ ID NO: 13586 - DNA, 348 bp, Homo sapiens
tgcgcgcctgcaggtcgccactagtggatccaaagaattcggttcgagcttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 13587 - DNA, 329 bp, Homo sapiens
cgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccctgttttgaaagccccttatttataacttttatactttgtgcaggtcgcggcgcttcctgcctcatcctcggctgcatggggcggggggcgcttgtttttaacgtgcccgtttgtactga

SEQ ID NO: 13588 - DNA, 160 bp, Homo sapiens
ttcggcacgaggcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatcccc

SEQ ID NO: 13589 - DNA, 328 bp, Homo sapiens
ttcggcacgagagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagc

SEQ ID NO: 13590 - DNA, 342 bp, Homo sapiens
ttcggcacgagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgt

SEQ ID NO: 13591 - DNA, 345 bp, Homo sapiens
  misc_feature 42, 161, 193: n = A,T,C or G
gctccccaaaaggctgagtggctgactgaattaagtaccagngacatgcagtaactgctaagatagatgagccatctgtatgctctgacagttacagactgaataagttggagacttccctaaagggtggcatttccccagggtaacaacgcagagctcangtgtgggaaggtgccaggggcaggggtgcaanaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaaga

SEQ ID NO: 13592 - DNA, 334 bp, Homo sapiens
ctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagaga

SEQ ID NO: 13593 - DNA, 355 bp, Homo sapiens
  misc_feature 15: n = A,T,C or G
taacaggccaagccntctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagag

SEQ ID NO: 13594 - DNA, 331 bp, Homo sapiens
cggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcag

SEQ ID NO: 13595 - DNA, 331 bp, Homo sapiens
gaataactcaaataattagaaaatgttccttttactgagatgcagttggtcttcatctattcatgctctaaacagttcctaagcgctgactgtgcgctagacactgccaggcccgggcctcgaggaggaaaagacagtagggaagacattatagagcatgaagtcaccataattttccctaaagcatgcttattgacaattgaggaacaaagtgttgtggagcagaagaaggagtccctcaccctaggtgtgagatgggattctggaagcttcctgaaggatttgagtgggaccttgtgggaggcgtgagagtccatgaagggggtgtgag

SEQ ID NO: 13596 - DNA, 337 bp, Homo sapiens
cttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcatctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttac

SEQ ID NO: 13597 - DNA, 340 bp, Homo sapiens
caaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccag

SEQ ID NO: 13598 - DNA, 282 bp, Homo sapiens
  misc_feature 156: n = A,T,C or G
ttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctangagggcttgctgtgcggagggcctgctatggtgtgctgcggttcatcatggagagtggggccaaaggctgcgaggttgtggtgtctgggaaactccgaggacagagggctaaatccatgaagtttg

SEQ ID NO: 13599 - DNA, 279 bp, Homo sapiens
  misc_feature 159: n = A,T,C or G
tttttttttaagcttttaaaattctgatagttattgccaaattgcacagatcacatttcccttggcaaagtatgagagaacctgtttacctgtgagacttaaacaaaaatacactagtattttacatacaataaacaaaaatactcagaggccctgggngtggggcctgggctctgtattgggagcctcagagaggggttctgagccaggaactctcctgggcttcttcgccctccagccccgctctccccccaggatttgctgatgagcctgagatga

SEQ ID NO: 13600 - DNA, 335 bp, Homo sapiens
atctgcatggcctgatcctcaggccctgactcaatctttctgcatgctacattgagtcacttggccttgaaatctgagcatggttaaaagttgaaaatcattctagggtctgttttctaccaacctcctggtataccattattttgtccttataaaaaggagataaaaatgtcacaggcagaacttggaagaaaaattcaagtaaatagaacaataaacttcataaatagaaagtgctttcagagtgtgtcccaggcaaggttatgcatggtttgaaaagaactgaattttaatagacaaaatgttgcactctaaatgctttttacaatggtagc

SEQ ID NO: 13601 - DNA, 337 bp, Homo sapiens
tggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggtgcgccctgggtctcctcccctccttcctgccttgtgtatgctcaagccgttcctcctgggcactgtccccacctag

SEQ ID NO: 13602 - DNA, 303 bp, Homo sapiens
ccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactg

SEQ ID NO: 13603 - DNA, 301 bp, Homo sapiens
  misc_feature 147: n = A,T,C or G
ttcggcacgagcaaaaacaactgtttggtttacctcagttgcagtagttattttcatttagaagttgttctcagattattgtttcagttatatagaggattactagactagttatgaagaaaccccactacattcaatggaattggngcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagc

SEQ ID NO: 13604 - DNA, 266 bp, Homo sapiens
agaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttga

SEQ ID NO: 13605 - DNA, 338 bp, Homo sapiens
ggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaag

SEQ ID NO: 13606 - DNA, 292 bp, Homo sapiens
gaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatc

SEQ ID NO: 13607 - DNA, 256 bp, Homo sapiens
ataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagatacccattttaaaattatggccccccggtaaaaatgtc

SEQ ID NO: 13608 - DNA, 339 bp, Homo sapiens
  misc_feature 233, 335: n = A,T,C or G
aaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgnggatgtttcagttacaactgtaatgttatttatagaacaacattaatccattaaagctaacctatttttcaatatttatgataatctatgtacatatattgnctgt

SEQ ID NO: 13609 - DNA, 283 bp, Homo sapiens
  misc_feature 176: n = A,T,C or G
ctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcagttactaaaagatgtaactgaactgcagatccttggngaaatatctttcaacaaatctctatatgagggactgaatgcagagaaccacagaactaagatcactgtcgtcttcctgaaagatgaaaagtaccattctttgcctat

SEQ ID NO: 13610 - DNA, 310 bp, Homo sapiens
  misc_feature 100: n = A,T,C or G
gcattttgacagtgctaaaagccacataaagttcaagtaagacagtttcagaaatgtataaacatgaatgcctttgcagtgacttaagtgtgattctggngtttccttctaaaaatactgccttctcaggtgtgggaaggattctatctttttaggctttaccaccatagttctctgcaggcttgcaatcctgaatcaggcttgacttcagaaagtgctttaaaagggaggctgggcgccggtggctcatgcctgtaatcccagcactctgagaggctgaggttgtggggaaaagcaagagagatcaaga

SEQ ID NO: 13611 - DNA, 263 bp, Homo sapiens
ggaacttgaatgaaggctgatctttgttttgtgcactgtggccctgccaggcatatagtgaaggtgaatgtcttctccctcagaaaaaaattggttccttgctgtcccagtaaggcatagcttttccagccctaactttaaaactcagtgaggacttagatgggaaagaatgaggtaaatacaaaggattgcaggacaacaactacagcgttgtgtactgtgggaaggggagttgggcactcttggaggactcctgctgaagg

SEQ ID NO: 13612 - DNA, 219 bp, Homo sapiens
ggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtga

SEQ ID NO: 13613 - DNA, 265 bp, Homo sapiens
  misc_feature 219, 257: n = A,T,C or G
ggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaanatgaagcttcctggccgggaaaacaagacggccgtggntgtgggga

SEQ ID NO: 13614 - DNA, 328 bp, Homo sapiens
agagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagcctaaatgtgtcagagaatttatgtgagaaaggactaaagcacagacactttcagcctttatactaaataagagtattttttgtacagaataatctaaagg

SEQ ID NO: 13615 - DNA, 318 bp, Homo sapiens
  misc_feature 124: n = A,T,C or G
ctcatatcaagaaggaatttgacaagaagtacaatcccacctggcattgcatcgtggggaggaacttcggtagttatgtgacacatgaaaccaaacacttcatctacttctacctgggccaagnggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgtttttgtacagggcattctctgtactagtttgtcggg

SEQ ID NO: 13616 - DNA, 339 bp, Homo sapiens
  misc_feature 128: n = A,T,C or G
ctaggactctgcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgat

SEQ ID NO: 13617 - DNA, 271 bp, Homo sapiens
  misc_feature 184: n = A,T,C or G
cgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaanaagtcttcaggggagattgtctactgtgggcaggtgtttgagaagtcccccctgcgggtgaagaacttcgggatctggctgcgctat

SEQ ID NO: 13618 - DNA, 342 bp, Homo sapiens
  misc_feature 337: n = A,T,C or G
gtggatccaaagaattcggcacgagcaagcttatacctatacataaaattcctgttactggtttttggccttttgcaattatgagagctagttaagtgtgtctgcaaggccattgtctctgcattgaatgctagatagagctcaaagctcaaagggctggaagtcagaaaggtaagatagatgtaaagttgggaggttgagggcagactcaacccacaagcttcagctgaaaccccttgaggatggactgaaacttgttgcttctggccttggtgatgtaggtattctacagacaccatacatatcatttgtcatagagctaaacatagcacttggnccagc

SEQ ID NO: 13619 - DNA, 224 bp, Homo sapiens
ggaggctgggaacctcctggaaaaccactccttgaagaaagatatgagagacatttagaagtgattcctgctttcagaaggaggtggattcaaatacatcaaaagtcctttcctctgctaagtgtttatagttcaatgaataatttcaatatttgtatgtgttcttgtcattttatttttttctgaaaaacttccaaaaatttgaaaataaaattacagccttt

SEQ ID NO: 13620 - DNA, 163 bp, Homo sapiens
  misc_feature 159: n = A,T,C or G
ctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgatnaagg

SEQ ID NO: 13621 - DNA, 297 bp, Homo sapiens
  misc_feature 296: n = A,T,C or G
agaagatgaagtacaaggccattagcgaggaactggacaacgcactcaatgacatcacctccctctgagccccacaccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggnc

SEQ ID NO: 13622 - DNA, 183 bp, Homo sapiens
cgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcag

SEQ ID NO: 13623 - DNA, 228 bp, Homo sapiens
ttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagagg

SEQ ID NO: 13624 - DNA, 297 bp, Homo sapiens
atcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactg

SEQ ID NO: 13625 - DNA, 207 bp, Homo sapiens
tctcaccactgcactgcttatggttgaccgtcagctttgcttttttgaccatagtcttacagccctggcttagccttctctgaaaacatacatttgcacactaagccagattcacatgggaggtacattatgccgtggcctagtctagtgtgtatttcccctttctctccccacaaagattttacaaaacttatacatgcaaacagg

SEQ ID NO: 13626 - DNA, 166 bp, Homo sapiens
  misc_feature 78: n = A,T,C or G
gtcagcggtgcagcgtgtgtgccacctcattattatctagctaagcggaacatgtgcttcatctgtgggatgctgaangagatgagtgggcttcggagtgaatgtggcagtttaaaaaataacttcattgtttggacctgcatatttagctgttttggaacgcagt

SEQ ID NO: 13627 - DNA, 242 bp, Homo sapiens
ttcggcacgagctgctccgaaagctgcaagcgtgcctacacacacttcacaaagcagatggtttcttttgctttccatgtggtctaaaaatcaaatggacttttaatggaaaggttggggaattccacactcaattatgaatccagtgcagtgcaaggggcagagagatggtataccacaccttttagaagaatttgttactcctggtctcatctggcattggagtggggaggtgagaaaga

SEQ ID NO: 13628 - DNA, 330 bp, Homo sapiens
gtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtctta

SEQ ID NO: 13629 - DNA, 173 bp, Homo sapiens
  misc_feature 18, 146: n = A,T,C or G
cctccctcagcctcccangtagctgggactacaccacactgggactacaccagctgccaccatgcctagctaattttttggatttttagtagtgacagcgtttcactgtattggccaggatggtcttgatctcttcaccttgtganccccttgccttggcctccaaatttgct

SEQ ID NO: 13630 - DNA, 116 bp, Homo sapiens
gccaactaatatttcactttacatccaaacatcactttggcttcgaagccgccgcctgatactggcattttgtagatgtggtttgactatttctgtatgtctccatctattgatga

SEQ ID NO: 13631 - DNA, 135 bp, Homo sapiens
aaaatggcggcagcgatggatgtggataccccgagcggcaccaacagcggcgcgggcaagaagcgctttgaagtgaaaaagtggaatgcagtagccctctgggcctgggatattgtggttgataactgtgccatc

SEQ ID NO: 13632 - DNA, 307 bp, Homo sapiens
gccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattg

SEQ ID NO: 13633 - DNA, 188 bp, Homo sapiens
cggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggc

SEQ ID NO: 13634 - DNA, 339 bp, Homo sapiens
gagaaaatcacctttactaaaaggaaaggaagggaagtaggaagagaagaccacaaaacaactggaaatcaagaaacaaatgacagaaataaatcactacttatgaataataccagtgaatgtaaatggactaaactgtccaatcaaaagatataaaatagctgaatggatgaaaatacaagaccccatgatccattgcctacaagaaacacatttcaactataaagatatacatggactgaaaataaagggatgaaaaaagatatttcatgccaatggaaacaaaaaaggagcaggaatagctataaacactctaagaagacacaaagaacatcatta

SEQ ID NO: 13635 - DNA, 152 bp, Homo sapiens
gagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccatt

SEQ ID NO: 13636 - DNA, 340 bp, Homo sapiens
ttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttc

SEQ ID NO: 13637 - DNA, 188 bp, Homo sapiens
  misc_feature 144, 176: n = A,T,C or G
ctggatcccaggggctgtccccacgctggccttcgcctccctgaagtggctttctgcagtgactttgtccattgatctgtttactgccttccctggggccacaagggagcctgccagggtggggcccatggttgtgttcttggnactgccagggcacagcctgccccgggtgctgnagaccttcctgt

SEQ ID NO: 13638 - DNA, 339 bp, Homo sapiens
ctcgtgccgcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcg

SEQ ID NO: 13639 - DNA, 159 bp, Homo sapiens
cagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatct

SEQ ID NO: 13640 - DNA, 329 bp, Homo sapiens
cacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggggtaaaggctgtctttttttttttttt

SEQ ID NO: 13641 - DNA, 321 bp, Homo sapiens
  misc_feature 230, 249, 260, 273, 293, 305: n = A,T,C or G
gaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctncagtggaagtgcacaggcnctcccaatgtngggaatgctctgncttgcatttggtctggaatnctacgtgtgggngtgtgggggcatgcat

SEQ ID NO: 13642 - DNA, 189 bp, Homo sapiens
gtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagt

SEQ ID NO: 13643 - DNA, 270 bp, Homo sapiens
  misc_feature 64, 95, 97, 107, 140, 208: n = A,T,C or G
ctccgggcaccttccttgaaggagtggctaaggttggacaatacacgttcactgcagctgctgncggggccgtgtttggcctcaccacctgcatnancgcccatgtncgcgagaagcccgacgaccccctgaactacttnctcggtggctgcgccggaggcctgactctgggagcacgcacgcacaactacgggattggcgccgccgnctgcgtgtactttggcataacggcctccctggaaaagatgggccggctggagggctgggagg

SEQ ID NO: 13644 - DNA, 338 bp, Homo sapiens
cgtgaatcaatattatcaacaccaagtggaaattgatttgaaatgcagaatttgaggccctccccaaacctattgaatcaaaatcaacttttgaaccaaatctcaaggtgatctctatgcactttaaggacagaagaacatggctctggcacattgctcccacattttcccccaggatactgaatttttggaaagttgagaacagttatcttttttttcacaactacttttacagtcacttacctgaatataaaagtcacttacatccatttttggacatttggaaaatggcaattttatgttctactttgtttttctgtttctgggtgtgctttagt

SEQ ID NO: 13645 - DNA, 256 bp, Homo sapiens
  misc_feature 202, 239: n = A,T,C or G
ggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagccccctangctccaagagcccccaaccgggacccaaccctgcctncctgggctaggctctgg

SEQ ID NO: 13646 - DNA, 159 bp, Homo sapiens
ctcgtgccgaattcggccgagctctcccatcaagcttcagatgccatgttgtactgggggaatgtagcccttgtgctccccaccccctacctccacctgagcctcaccctgctgttgagccctgagtggctaggggaaatgggaagaggattgccatgg

SEQ ID NO: 13647 - DNA, 217 bp, Homo sapiens
ggctcatgcctttaatctcaacactttgggaggctgaggcaggtggatcacctgaggtcaggagttcgagaccagccaggaccaacgtggcaaaaccccgtctctactaaaaatacaaaaattagccaggcgtggtggcaggcgcctgtaatcccagctacttgggagattgaggcaggagaatcgcttgaaccaacaagagcaaaactccatctcc

SEQ ID NO: 13648 - DNA, 339 bp, Homo sapiens
atacggtggaactcgcgatactttcccaggaatgtcagtcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtata

SEQ ID NO: 13649 - DNA, 107 bp, Homo sapiens
gcaaagtgggtctcattgctgcccgccggactggacgtctccggggaaccaagactgtgcaggagaaagagaactagtgctgagggcctcaataaagtttgtgttta

SEQ ID NO: 13650 - DNA, 267 bp, Homo sapiens
  misc_feature 267: n = A,T,C or G
gagagcccatgtgttgtgagggttcttctgggaactctgagaaggcaggagccgcccccgcccttcactgcctctcttccattctgcagcatggaatatggatgtgtggtctggatgtacagacaccattttggaccataaagacaaggacgattgtctaaggatgacacagccagagcactgagagtggcgagaaggacaggggagctgctgtgccaagcaggactgtctctcttaagagaaaaataaaatttattggtgtttaan

SEQ ID NO: 13651 - DNA, 335 bp, Homo sapiens
cccaactctcctccctagctagagcaccagccctgggaacacggggctttaggtctgcttgaaggtgaggacgtgactcccacatgtaatcaggagaaagggacagaggaagccccagcccccactgtggctatcctgactccagtggccacatctcaggtgccaggggctgtgggagcttgtgccgtccttggccaaacaccccgcaggcaaagatgcacccctgctgatggagagccttctgcttctgccctctggccctctaccataccacttccccagccagaaccggcgtgcagctaggaggaatgggttgcacggcggagggggtgagg

SEQ ID NO: 13652 - DNA, 335 bp, Homo sapiens
cgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgac

SEQ ID NO: 13653 - DNA, 229 bp, Homo sapiens
ctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaat

SEQ ID NO: 13654 - DNA, 337 bp, Homo sapiens
aaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattat

SEQ ID NO: 13655 - DNA, 338 bp, Homo sapiens
  misc_feature 111, 323: n = A,T,C or G
tttattgcgcttataaccttaatagttgtattcattacatttcaacatgtccaaggttagcagacatgtagttcctgaaaaccaacattttaaaaattagctgggtgtggnggcacacgcctgtagtcccagctacttgggaggctgaggcaggagaatcacttgaacctgggaggcggaggttgcagtgagccaagattgcaccgctgcactccagcctggcaacagagcaagactccatctcaaaacaaacatacaaacaaaaaaaggtgcctctggtcctgtgttttctttttccttctgaaagttcatagaaacctggnatatagagcttattt

SEQ ID NO: 13656 - DNA, 273 bp, Homo sapiens
agaggtcacgattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtgggaactgtaggag

SEQ ID NO: 13657 - DNA, 236 bp, Homo sapiens
  misc_feature 133, 189, 191, 212: n = A,T,C or G
ctttgatgtggtgtcaatttggggccttgtgtttgtgccagagggatacacatattaaactgcaggccaccttcctggtccagactgtactgtgtgaaccccactgactaaattagtgagaaccataggcgtnggaatttctcaccttttacaatgatagacttttgcattgggaccaatgaatctggngngaaaaaccctgctgtagtagngaaagagcatggggagatactgac

SEQ ID NO: 13658 - DNA, 324 bp, Homo sapiens
ttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactat

SEQ ID NO: 13659 - DNA, 338 bp, Homo sapiens
caggtgcccaaggaaaggcatctcaagttttaatgcgcatacagatagcttgggatttgttaaaatgcagattctgatccagtaggtatgggtggaaataaacccacgtttgtgtacagatgtttctcttgtggtatgtggttggtaatcatcctcagtatgtttccatttctggcaaactgggttgagttgatgaccctattcttactcctccctgaaacctttgtctctccctcaggctcccagttctcattaatcactactttctgtgatattctgaagcaattattatctttaactgccttttttcattagctacttctctatctgcttatgta

SEQ ID NO: 13660 - DNA, 339 bp, Homo sapiens
  misc_feature 230, 257, 317, 318, 333: n = A,T,C or G
ggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagnggcaataatattgaactgggcacagcntgcggaaaatactacagagtgtgcacactggctatcattgatccaggtgactctgacatnnttagaagcatgccangaacag

SEQ ID NO: 13661 - DNA, 189 bp, Homo sapiens
ctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggcc

SEQ ID NO: 13662 - DNA, 339 bp, Homo sapiens
cattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcat

SEQ ID NO: 13663 - DNA, 277 bp, Homo sapiens
  misc_feature 220, 235, 248: n = A,T,C or G
gtggcgtgttttttcatggggattgtgaatcagtctaaagcaaaatatgtgtttatgatttgcatgtaaggtaactgaagtttagcaaaaacaataatttgtcatttagaaatgatcccagtctttggaaatatttagaataataaatttcaggttaagtttttttttcacggtttaatcaagttaagatttttgggatacttagtatttgggtggcttnactaaaagaaaaatntttattggcattncattaaactgctgaaaaattaaacgaaga

SEQ ID NO: 13664 - DNA, 372 bp, Homo sapiens
aaaagctggagctcgcgcgcctgcaggtcgacactagtggatccaaagagccggcgttgctgtagcgcgtctgggaattacaccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgg

SEQ ID NO: 13665 - DNA, 190 bp, Homo sapiens
  misc_feature 159: n = A,T,C or G
aacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttngtatattatgggggacaataaatatacattg

SEQ ID NO: 13666 - DNA, 330 bp, Homo sapiens
gtttgtttgtttgtttgtttgtttgtttgtttaaaaaaaacggagtttcgctcttcttgcccaggctggagtgcaatggcatgatcccggctcgctgcagcttttgcctcccgggttcaagcgattcttctgcctcggcctcccaagtagctgggattacgggcatgcaccaccacgcccagctaatttttgtatttttagtggagatggggtttcatcatcttggtcaggagttcaagaccagcctggccaacatggtgaaatcctgtctctattaaaaatacaaaaactagctgggcatggaggcaggggccttgtaatcccagctac

SEQ ID NO: 13667 - DNA, 285 bp, Homo sapiens
  misc_feature 244, 264: n = A,T,C or G
gcctctccctccacacctccctgcaagctgaggaagccggctccggccttggccagcacagaaaggggctcccacagtgcagcggtgggctgaagggctcctcaagtgccgtcaaagtgggagcccaggcagaggaggcgcagagagcgagcgagggctgtgaggactgccagcgtgctgtcgtcgtcacctctcagtagcactgatacgtagcgcttatgcttaatttcatgcttgaaattanaataatgccttttaaaaatntgtgatgctctgtcagtaggt

SEQ ID NO: 13668 - DNA, 313 bp, Homo sapiens
ctcaagcaactatgttgtttctgctaaaatgcctagaagaaatagtgtcaagagaaaaataaacccaagataggggaagagatttataagacagcatcttgctctcctcaatgattgaattacccaggatgcatgacacagggaaagggaaagccttgatttgtaccatctattgattcctgtggtgtaaatcctctcactacagctggtttcaagataccagtgtggagttgggaagagatgtacacagccggctctcacaagccagtaagagccaggtcctgtatatcactccctgcataagaactacatt

SEQ ID NO: 13669 - DNA, 400 bp, Homo sapiens
  misc_feature 6, 18: n = A,T,C or G
gctcgngcgcctgcaggncgacactagtggatccaaagaattcgggcacgagggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaag

SEQ ID NO: 13670 - DNA, 266 bp, Homo sapiens
ctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctcttgggggtgggg

SEQ ID NO: 13671 - DNA, 358 bp, Homo sapiens
  misc_feature 272: n = A,T,C or G
tggggatcgaggatctgggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacanaatatcttgccctaaatgtcctcttccctcttgccatcgtgcaaaagcattcgatcttatgaccgtgagttcttattttgtggatg

SEQ ID NO: 13672 - DNA, 319 bp, Homo sapiens
  misc_feature 173, 270, 296, 311, 316: n = A,T,C or G
gttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcanagctgatgatctacgtttccatggccgccacctttgggttccacaacttaacttggtggctagtggtgacaaatgtcttctttaatcaggccctgtntgcctttctcacccaccaattctacnaaagcaaatttgggntggtnacg

SEQ ID NO: 13673 - DNA, 143 bp, Homo sapiens
  misc_feature 119, 130: n = A,T,C or G
aaaccatctcccccaggaccttctgtctgggactcaggagtcctaaggaaaaggaattctaaaacatgggggaaggggaggtagagcactgatgggtgaaaaagtgaggcccacacacngggcaagtggngtcgatggagtcg

SEQ ID NO: 13674 - DNA, 274 bp, Homo sapiens
  misc_feature 263, 270: n = A,T,C or G
ctgaaacaagacatcgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtctantgaattnaaca

SEQ ID NO: 13675 - DNA, 230 bp, Homo sapiens
gattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctg

SEQ ID NO: 13676 - DNA, 335 bp, Homo sapiens
cacaaatggagtgcttcttgactctcgctgtgactacagctgttccagtggctaccacctggaaggtgatcgcagccgaatctgcatggaagatgggagatggagtggaggcgagcctgtatgtgtagacatagatccccccaagatccgctgtccccactcacgtgagaagatggcagagccagagaaattgactgctcgagtatactgggacccaccgttggtgaaagattctgctgatggtaccatcaccagggtgacacttcggggccctgagcctggctctcactttcccgaaggagagcatgtgattcgttacactgcctatgaccgag

SEQ ID NO: 13677 - DNA, 258 bp, Homo sapiens
  misc_feature 72: n = A,T,C or G
gtagtggttgcacagtcacactgatatgctgatttgctctttctcattgtatgtctatgctttgtcatcagngctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattca

SEQ ID NO: 13678 - DNA, 246 bp, Homo sapiens
cgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggac

SEQ ID NO: 13679 - DNA, 295 bp, Homo sapiens
  misc_feature 223: n = A,T,C or G
tggcaattaaaatgtggtcaaagagatatatacttggtgattgccatttgtgaaaatttcagtgataagcattacagcttactaagaagagcaagactaattaactagtcttaaaatagatgaaaattgaggggaaatatcagagatttaggactagaataagtcaacaactttatgataagatctgtgtgtaggcacctactatatttgttctgtttctagngctgtgtaggttttaagagttcaatgtgttccagtgttctgagtgtctacatttttcactcctcatagctac

SEQ ID NO: 13680 - DNA, 216 bp, Homo sapiens
  misc_feature 158, 164: n = A,T,C or G
ctgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgngcttanaaaggttgcagatttcatcttcacctaccaagaggcggccgcctccttggac

SEQ ID NO: 13681 - DNA, 338 bp, Homo sapiens
atttgaaggaaaatgaaaacatggatagctgtcctaaataaatcagtcaaggaacaagagtgcttaaagtattttttatttgtttgtttaaactggaaaaatggattgaggtaggtatgggtatcaaatggaccccaccctctaatttcattgattttcttgttattagcaatttgactcttgattataaccatgtggctgggaatttttattaagatagagaggcggtccaacagttttttatgaaagcgcaattacagtgaaaggaaaataaacatgttattgtgtttttaaaaatgcttgaagaatttgtaatcatggacttttatacaccattt

SEQ ID NO: 13682 - DNA, 334 bp, Homo sapiens
  misc_feature 86, 266, 310: n = A,T,C or G
aatttcagctttcctcatgcaaaaggattttgtctccccggcctacttgaagaagtggtcaagctaaaggaatccaggttgttggntggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctancccaggccctggggaatcaggtgactcacacaaatgcaatagtnggtcactgcatttttacctgaacc

SEQ ID NO: 13683 - DNA, 123 bp, Homo sapiens
  misc_feature 4, 29, 32, 46, 50, 54, 56, 59, 61, 69, 72, 79, 82, 99, 105,108: n = A,T,C or G
aacngaccactggggaatccaaagcattntantggcgcctctttantggngtgntntantnaccagtgngantttatanganattcctaaaacattgangctganggntgcaagaatttacat

SEQ ID NO: 13684 - DNA, 214 bp, Homo sapiens
  misc_feature 172, 193, 213: n = A,T,C or G
acgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggnttatatttttttgaaggaggnaaattatatgcaaattttang

SEQ ID NO: 13685 - DNA, 338 bp, Homo sapiens
gttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaaag

SEQ ID NO: 13686 - DNA, 315 bp, Homo sapiens
  misc_feature 157, 282, 300: n = A,T,C or G
attccttgccactttcagcttctggtgactgccagcaatccttggcttgtgtccacttcattttaatctttgcctctgtggccacattgcctcttcctcttctgtctgtcaaaccccctccatgtgtcttataagaacacctgtcattggatctagngcccacccagataatgcaggatgatctttttatctcaagatccttaacttaattacatctcaaagactctaaatgtaatgaacatatttagaaatgaggacatggacatatcttttctggcggtnaccactgaacccactttngggaacacaggctat

SEQ ID NO: 13687 - DNA, 338 bp, Homo sapiens
  misc_feature 307, 330: n = A,T,C or G
taccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcanagataaagtcccccaaatatggngaaggcca

SEQ ID NO: 13688 - DNA, 111 bp, Homo sapiens
gaaggactccagctctatggaaggcgcgccccctgggaggatcctgccaagtgggtgatggacacatatccatgggcagccagcccacaacagcacgagtggcctcccctg

SEQ ID NO: 13689 - DNA, 201 bp, Homo sapiens
  misc_feature 152, 191: n = A,T,C or G
tgacgtaccagagtgaagaggacaggaagaatgtgctgagattgcaggatctggtggataaactgcaagtgaaagtcaagtcctacaagaggcaggcggaggaggctgatgaacaagccaatgctcatctcaccaaattccgaaaggctcancatgagctggaggaggccgaggaacgtgcggatatcgcngaatctcaag

SEQ ID NO: 13690 - DNA, 193 bp, Homo sapiens
ctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcag

SEQ ID NO: 13691 - DNA, 219 bp, Homo sapiens
gaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgagg

SEQ ID NO: 13692 - DNA, 283 bp, Homo sapiens
  misc_feature 95, 224: n = A,T,C or G
atggacattaaaatctcaattaatactattgcaactattgaatcaaatataaattgaattaaatttttaaattcaacagaaaatagcaaattggntactagaatattttgtctctaccaatttcactattacttctgaggtgtaaaccaaatataatactggcataaagaaggaaaaatatctcaagatttctaggcattttcctatgtctaatagtaggatgntctctctgaatttatttattacaaaaataacattacaacaataaagcaaaataatattt

SEQ ID NO: 13693 - DNA, 100 bp, Homo sapiens
  misc_feature 6, 81: n = A,T,C or G
cacatntagggctcctgacagtatctgtcaagatgctggccccaaaccctgagtttgtcatgttatgtgggcatatttggntgcgcaactggtggaaggc

SEQ ID NO: 13694 - DNA, 339 bp, Homo sapiens
gctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaaggaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctgggggaaagcgggaagcgctcgc

SEQ ID NO: 13695 - DNA, 298 bp, Homo sapiens
  misc_feature 281: n = A,T,C or G
ctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttanttacaattcatacaaag

SEQ ID NO: 13696 - DNA, 148 bp, Homo sapiens
  misc_feature 69, 70, 125: n = A,T,C or G
cagcagcatattgcagcccaacagaaggcagctttgcagcatgctcatgcacattcatctggatacttnntcactcaagactctgcatttgggaaccttattcttcctgttttacctggccttgncccataatgaagaaaacatttgc

SEQ ID NO: 13697 - DNA, 336 bp, Homo sapiens
ccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaag

SEQ ID NO: 13698 - DNA, 257 bp, Homo sapiens
  misc_feature 251: n = A,T,C or G
gttttgcttgtttgtttagcttcaaggtctttggtaaagtcacatgttaaggatgactgaaataattccaaaggagtgatgttggaatagtccctctaagggagagaaatgcatttgaacgaatgtgatataaaaccacataatcaaatagaaacttcatgtacttacaaaaactgagtttgtaaaattaccttcatttctttgacattaaatgcttatattagcaataaacatgttgacactttcctatnaaaaat

SEQ ID NO: 13699 - DNA, 335 bp, Homo sapiens
  misc_feature 240: n = A,T,C or G
cagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggntgcacgaaacacactggggaatggagcaaaacagtctttgaatatcgaacacgcaaggctgtgagactacctattgtagatattgcaccctatga

SEQ ID NO: 13700 - DNA, 316 bp, Homo sapiens
  misc_feature 205, 232, 297, 303: n = A,T,C or G
atgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgcctggagaagtctggcttcgcgtcgactgccgcaacacagaccanacctactggtgtgagtacagggggcancccagcatgtgccaagcttttgctgctgaccccaaaccttactggaatcaagccctgcaggagcngaggcncctttcaccatgc

SEQ ID NO: 13701 - DNA, 281 bp, Homo sapiens
  misc_feature 215, 221, 250, 279: n = A,T,C or G
ccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcangctgtncccaagctcccaagagctttccagagctnttgaccccacagccttccaaagtcaggtngg

SEQ ID NO: 13702 - DNA, 277 bp, Homo sapiens
  misc_feature 210: n = A,T,C or G
gttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagntgtggttcttattgaaacagtattatataatgtttgcttaattatatcatgtgatgctcagttctat

SEQ ID NO: 13703 - DNA, 105 bp, Homo sapiens
cttcttttgaatttgaactctggagttactgttctacagtttggcggggacggggcttgggggttttctcttttgtttgtttccctttctttttccttttttttt

SEQ ID NO: 13704 - DNA, 302 bp, Homo sapiens
  misc_feature 288: n = A,T,C or G
gacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtcttttcccttccancctggaagtgttgc

SEQ ID NO: 13705 - DNA, 336 bp, Homo sapiens
  misc_feature 254: n = A,T,C or G
gctcagtattaagcagacagcaggtagatgaacatgtacgaggggtctgtgctcacaggctttgtaacatcatcattctttctgggctgtctctcttttccagatgcctatgatttggtatttctcctggccagagagtagcactggaaacattgaacacaaagtattctaacccttattgctcaatgtgtttttccagagcagcccaaaaggttatgctgggtttcatgagctgcagaggatgactgactggngccacctagaaagacaaacagcagaaactgcagagcttggactgagctcaaacaaaaatctctgctgcttgtacccagcttg

SEQ ID NO: 13706 - DNA, 339 bp, Homo sapiens
  misc_feature 129, 227: n = A,T,C or G
cggcagccatcaggtaagccaagatgggtgcatacaagtacatccaggagctatggagaaagaagcagtctgatgtcatgcgctttcttctgagggtccgctgctggcagtaccgccagctctctgctntccacagggctccccgccccacccggcctgataaagcgcgccgactgggctacaaggccaagcaaggttacgttatatataggattcgtgttcgccgnggtggccgaaaacgcccagttcctaagggtgcaacttacggcaagcctgtccatcatggtgttaaccagctaaagtttgctcgaagccttcagtccgttgcagaggagcgag

SEQ ID NO: 13707 - DNA, 265 bp, Homo sapiens
gccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggc

SEQ ID NO: 13708 - DNA, 327 bp, Homo sapiens
ctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccaagcagcctttgtactctgcttgcggagggctgggagaccctccaagacattcccaccctcccccatgctgccaagtttgtagctatagctac

SEQ ID NO: 13709 - DNA, 284 bp, Homo sapiens
  misc_feature 229, 238, 261, 262: n = A,T,C or G
cttccctccccactccctgggagcctgcatcggagctgtaccattaaagagggttaagcgttgccctcccagggtgcatccgtaagcagtgcacgcagaggtgaactgagcacatgtttcctttccagatcctcagcacaggcctataagcctggagtctaggtgaagcctgggcccttcttggacagtattatttattatcttgctattatcatccattcagatatgntagggggtngacaacaaaactcatgtgatggnnaaataaaatgtggacttgaaag

SEQ ID NO: 13710 - DNA, 338 bp, Homo sapiens
  misc_feature 238, 298: n = A,T,C or G
cctgacctcgtgatccgcccgcctcggcctcccaaagtgctgggattacaggcgtgagccaccgcgcccggccgtctttcattgttaaattacccagtttcaggtatgtattttttagcagcatgagaacagactaatacatcttttcttggcagagcctttcttcatgtgccaggcttggtgtgcctgaagctatgctttctaaatggaccattctccttcttctttcctatgttgncctcctttttttcttcttccttcttcatcaggctgagatatttcaaataggaaggcccangaatttgcttacatattgagaaaattggaaataatgggag

SEQ ID NO: 13711 - DNA, 334 bp, Homo sapiens
aaggaaggaagaaaggaaggaaggaaggaaaatagaaatagaaatgcaagtaaagaatttcagtttgaaaattgccttttgtctactgaacatgagactgcttggaaactgggcaacgtggatttttataagttgtacaaagcacttagcaattttcaaacctctccatcctgcagagccagctcaatcacttctccagaaagacttactgagtcctctgcactgaacaggtgtcctatgctccaggagagccctgggctggctcctagtgcagccgttatgaccctggaatgcaccatctttcacatcactgcctggccttctagaatctcag

SEQ ID NO: 13712 - DNA, 341 bp, Homo sapiens
aagacctctgacatgccctggagacattttccccattgtcttggcaatttacatttggctcctggttacttatgcaaatttctgcagcaggcttaaatttctccatagaaaataggtttttcttttctatcacataatcaggctgcaaacttttcaaacttttatgctctgcttccttttcgaacataagtcccaatttcagatcatgtctctcaagttctaagttccacaggtctctagggcaagggcaaaatgccaccagtctctttgctaaagcacaacaagagtgacctttgcttcggttctcgagaaattcctcatctccgtctgagactacccca

SEQ ID NO: 13713 - DNA, 338 bp, Homo sapiens
  misc_feature 9, 264: n = A,T,C or G
atttgtgcnaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggnggtcacctttgctccagtcaacgttacaacggaagtaaaatctgtcgaaatgcaccatgaagctttgagtgaag

SEQ ID NO: 13714 - DNA, 305 bp, Homo sapiens
ctcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgc

SEQ ID NO: 13715 - DNA, 238 bp, Homo sapiens
  misc_feature 6, 226, 237, 238: n = A,T,C or G
gctcgngcgcctgaggtcgacactagtggatccaaagaattggacgaggtcgccgctgcgaagggagccgccgccatgtctgcgcatctgcaatggatggtcgtgcggaactgctccagtttcctgatcaagaggaataagcagacctacagcactgagcccaataacttgaaggcccgaaattccttccgctacaacggactgatttaccgcaagactgcgggcntggagccggcnn

SEQ ID NO: 13716 - DNA, 101 bp, Homo sapiens
  misc_feature 6, 23, 43: n = A,T,C or G
tggatntgacctacagcctctgnatgcacccctccagctcccnacctctgaatggagcccacaccctcctttccctgacctccttgccctcactcttctct

SEQ ID NO: 13717 - DNA, 228 bp, Homo sapiens
  misc_feature 100, 181, 183, 224: n = A,T,C or G
tctgggctttgaaccttttacatttgtccagtctagatgagtaggcttggggccagcaccctgtctcaaagatggcaaaatgaggctagttctggatganctagctggtgtgggttccaaccataggaacacactgatgctcaaatcctaaggtgccaagctctaggccctggaggctggnanaacaggatctatgcctggaatcctggcagggattcctgtcnagga

SEQ ID NO: 13718 - DNA, 301 bp, Homo sapiens
  misc_feature 114, 168, 214, 251, 252: n = A,T,C or G
gttggcggcttgtgcagcaatggccaagatcaaggctcgagatcttcgcgggaagaagaaggaggagctgctgaaacagctggacgacctgaaggtggagctgtcccagctgcncgtcgccaaagtgacaggcggtgcggcctccaagctctctaagatccgagtcgnccggaaatccattgcccgtgttctcacagttattaaccagactcanaaagaaaacctcaggaaattctacaagggcaagaagnncaagcccctggacctgcggcctaaaaagacacgtgccatgcgccgccgg

SEQ ID NO: 13719 - DNA, 116 bp, Homo sapiens
  misc_feature 111: n = A,T,C or G
gatggctgatctcactcccactgtctcgtagaattacactccttcctggggatccctcttcctgcagccttgtccttggggagtacagggaagtacctggagggaccctgncccca

SEQ ID NO: 13720 - DNA, 125 bp, Homo sapiens
cacctgtaatcccagctactaggaaggatgaggcaggagaatcgcttgaacctggaaggcagaggttccagtgagccaaggtcgtgccactgccctccagcctgggcgacagagagagaccccag

SEQ ID NO: 13721 - DNA, 272 bp, Homo sapiens
  misc_feature 183, 268, 270: n = A,T,C or G
tcaatcagggaagttctgggcaccctggggctcaggggatctcagggggtgaactatcacagatcaggacagcaaggttccaggaggatgagacagaggttccacgtctccaggcaagcagaggaatcacagcacactgggattacggaagttatgtccggcaaagcgagcttcatcccccanctcttcctcaattctgagagagatgaaccacaaaggaagtggtcagggatgcaggaggatccctgcttctctctttaggggtccncnga

SEQ ID NO: 13722 - DNA, 100 bp, Homo sapiens
gttactttcaacactgtttattccagcggaagcagccgggtggttttcccacccccgtgtatgtagatatatcgactttgtattaaaggaagatcgtctg

SEQ ID NO: 13723 - DNA, 170 bp, Homo sapiens
  misc_feature 170: n = A,T,C or G
atttatgttagtttcaacttctattccttctagttcaataatcttctcttctgcaatgtttaatccactgccttcttccacttcagactgtaaatcatactttttatctacagaatttgatatttaaaaaatcttcaacctccccatttaattaaaatacaattatactn

SEQ ID NO: 13724 - DNA, 258 bp, Homo sapiens
  misc_feature 188, 250: n = A,T,C or G
cttcgacgttggccctgtctgcttcctgtaaactccctccatcccaacctggctccctcccacccaaccaactttccccccaacccggaaacagacaagcaacccaaactgaacccccacaaaagccaaaaaaatgggagacaatttcacatggactttggaaaatatttttttcctttgcattcatntgtcaaacttagtttttatctttgaccaaccgaacatgaccaaaaaccaaaagtgcatggcnaccttacc

SEQ ID NO: 13725 - DNA, 337 bp, Homo sapiens
  misc_feature 38: n = A,T,C or G
cgttttcaggctatcttctttatcaagattgaaagtcngtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggc

SEQ ID NO: 13726 - DNA, 298 bp, Homo sapiens
ccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacatt

SEQ ID NO: 13727 - DNA, 170 bp, Homo sapiens
gtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctcta

SEQ ID NO: 13728 - DNA, 329 bp, Homo sapiens
  misc_feature 247: n = A,T,C or G
gtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgnggagcatcgcgtaaggcttcttgcttatttaaactgtgcaaggtaaaaatcaagcctttggagccacagaaccagctcaagt

SEQ ID NO: 13729 - DNA, 141 bp, Homo sapiens
  misc_feature 26, 68, 92: n = A,T,C or G
caaatacacaactgaagctccctgantgtgtgaggtccagaccacatgtgtgactatacataaacatnttacaccgaacattttgccaaggnttagcacattatttgtcatcaggattttctttattgtgaaccctctagc

SEQ ID NO: 13730 - DNA, 121 bp, Homo sapiens
  misc_feature 16, 18, 49, 59, 61, 66, 83, 105, 114, 116: n = A,T,C or G
aacaaaaaccctggtntnttcgcgacgccctgccaggctccgcacactnagtgcgactncncagangaaatctacggtcacgnagccagacaacattgaatacanaggggttgntntacca

SEQ ID NO: 13731 - DNA, 332 bp, Homo sapiens
  misc_feature 18: n = A,T,C or G
gaaaagacaactggcagngcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacgg

SEQ ID NO: 13732 - DNA, 112 bp, Homo sapiens
  misc_feature 106, 109: n = A,T,C or G
agtacttctagagcggccgcgggcccatcgattttccacccgggtggggtaccagggtaagtgtacccaattcgccctatagtgagtcgtattacaatttcactgnccnctg

SEQ ID NO: 13733 - DNA, 329 bp, Homo sapiens
  misc_feature 122, 308: n = A,T,C or G
tgaagatagatcgccatcatgaacgacaccgtaactatccgcactagaaagttcatgaccaaccgactacttcagaggaaacaaatggtcattgatgtccttcaccccgggaaggcgacagngcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtntgagaagaaaaagacctcaag

SEQ ID NO: 13734 - DNA, 197 bp, Homo sapiens
  misc_feature 90: n = A,T,C or G
taacaggtgtaagagtgttgaaaaaaaaattcaaatttttgggggagcgagggaaggagttaatgaaactgtattgcacaatgctctgancaatccttctttttctcttttgcccacaatttaagcaagtagatgtgcagaagaaatggaaggattcagctttcagttaaaaaagaagaagaagaaatggcaaagag

SEQ ID NO: 13735 - DNA, 324 bp, Homo sapiens
  misc_feature 114, 116, 283: n = A,T,C or G
ctttcttatcttcctaagtgggatcatttcttacaaatgtacgacttttccacttagaaaagaaaaaaatctgttttcatttgttttcaaattatttttctttttaatggcagntngattcccagtttgacagccatttggagctgctgaaggggaaaaagaaagaaaaaacccaacattttttcatgttcctgggtgaaataaatctgtttagtggaatattaaatgcccaaaatgtttcgattaattttggcaaactttagacaaatccaattgtccttgnctttcaaatatatgattgcagttaaggagaggaatttccta

SEQ ID NO: 13736 - DNA, 329 bp, Homo sapiens
cggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccag

SEQ ID NO: 13737 - DNA, 327 bp, Homo sapiens
  misc_feature 13, 42, 93, 140, 199, 327: n = A,T,C or G
gaccttttgaccnactccctgtcattcctaacctaaccttanagtccctcccccaatgcaggccacttctcctccctcctctctaaatgtagncccctctcctccatctaaaggcaacattccttacccattagtctcanaaattgtcttaagcaacagccccaaatgctggctgcccccagccaagcattggggccgncatcctgcctggcactggctgatgggcacctctgttggttccatcagccagagctctgccaaaggccccgcagtccctctcccaggaggaccctagaggcaattaaatgatgtcctgttccattggcn

SEQ ID NO: 13738 - DNA, 303 bp, Homo sapiens
cggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactg

SEQ ID NO: 13739 - DNA, 332 bp, Homo sapiens
  misc_feature 3, 28, 30, 31, 89, 92, 191, 330: n = A,T,C or G
gcnacactagtggatccaaagaattcgntnngagcagctgtctagaggacttccgcgccacaccattcatcgaatgcaatggaggccgnggnacctgccactactacgccaacaagtacagcttctggctgaccaccattcccgagcagagcttccagggctcgcccttcgccgacacgctcaaggccggnctcatccgcacacacatcagccgctgccaggtgtgcatgaagaacctgtgagccggcgcgtgccaggaagggccattttggtgcttattcttaacttattacctcaggcgccaacccaaaaattggctttatttttttntt

SEQ ID NO: 13740 - DNA, 396 bp, Homo sapiens
  misc_feature 2, 4, 38, 47, 161, 378, 391: n = A,T,C or G
tngngcgcctgcaggcccgacactagtggatccaaagnattcggttncgagatcaagttgtccccaacagccggataaaatattttgataaaagaagagactacttaaaattcaaagaaaaatttgaagcaggacaatttgagccttcagaaacaactgcnaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagnaaaacctgttatnaacac

SEQ ID NO: 13741 - DNA, 388 bp, Homo sapiens
  misc_feature 19, 25, 28, 52: n = A,T,C or G
acactagtggatccaaagnaattcnttncgaggagccaagtcatagatagcncagagaggtcaagtcgcttatccccaaagtcctgcactttttgttcctgctgtctcctttatgatgaaggaaaactgatcttaggtagctaacttgcagccattgactttgcattcagttgtatggttaaatccacttgtgatgggaaaatggctctaatttagctaacttgaatgaatagatcttcattgctagttgtctaatactccataatttcgataccctacgcctccaaaaaaacacaaactctcttgctgccataactcatgaaaaccaggtgtcagccattccaagtggtaggaatgagcaaatgattcattaggcagccttgtattt

SEQ ID NO: 13742 - DNA, 325 bp, Homo sapiens
ttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgagg

SEQ ID NO: 13743 - DNA, 294 bp, Homo sapiens
  misc_feature 7, 65, 135, 211, 277: n = A,T,C or G
cttcggncttctcaacttccaggccccctttctgccctgggtgctcatgggattttccttgttgntggggaactcaatcattgaggaccttttgggtattgcagttggacacatatattttttcttggaagatgnatttcccaatcaacctggtggaataagaattctgaaaacaccatctattttgaaagctatttttgatacaccagangaggatccaaattacaatccactacctgaggaacggccaggaggcttcgcccggggtgagggccancggcttgggggttaaag

SEQ ID NO: 13744 - DNA, 382 bp, Homo sapiens
  misc_feature 18, 20: n = A,T,C or G
gttaaagggtataaagtncncagataggaagaataaattctggagatatatcgtgcagcatagtgactgtagttaacaataacgtatggtatgtttgaaaactgctaagagagcagattttaaatgttctcaccacaaaaaataagtatgtgaggtgatagatattgatttaataatttcacaatgtatacatatgtgaaaacatcacgttgtaccccataaatgtatacaagttattgtttgtcaattaaaaataaactaaaaagaaaaaactagactaatatatctgaagaacacaaatgcaaaattcctcaacaaaatgttagcaaacagaattcaatagtatataaagagaattataaccataacaaaacagaattta

SEQ ID NO: 13745 - DNA, 218 bp, Homo sapiens
  misc_feature 31: n = A,T,C or G
gaaaagtgtgccccaagccttcatggacganttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttatg

SEQ ID NO: 13746 - DNA, 398 bp, Homo sapiens
  misc_feature 3, 11, 42, 88, 126, 369: n = A,T,C or G
tgngcgcctgnagggcgacactagtggatccaaagaattcgntacgagtggggatgggacctttcccctcctccatcagaggtgctcncaccctaggttacacgggaaagtgccccacatgcaagnctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccaggtgatttctgggtcccagggaaagaaagagagagctgatgcaggtttctacagtgaggaacaggcgtttcccaggccccacacccanatttctctatctttgctgtgttttatggc

SEQ ID NO: 13747 - DNA, 400 bp, Homo sapiens
  misc_feature 163, 172, 351: n = A,T,C or G
tcgagctgctttcatcttggacacctacaattatttttacagttctcccaagggagttaggctattcacaaccactcattcaaaagttgaaattaaccatagatgtagataaactcagaaatttaattcatgtttcttaaatgggctactttgtcctttttgntattagggnggaatttagtctattagccacaaaattgggaaaggagtagaaaaagcagtaactgacaactttcgtgaagtatactgtatttttacctttttccttccttatcactgacacaaaaagtagattaagagatgggtttgacaaggttcttcccttttacatactgctgtctatgtggctgnatcttgtttttccactactgctaccacaactatattatcatgcaaatgc

SEQ ID NO: 13748 - DNA, 297 bp, Homo sapiens
  misc_feature 7, 135: n = A,T,C or G
ttcggcncgagccctgaagttttacgtgccttgcaagcagtgcccccccatgaagaaaggagtcaagttatctgctgatgggccaggtagaagagaacagaggccccgtccttcctccagagagctttgaggttnttcaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgagg

SEQ ID NO: 13749 - DNA, 288 bp, Homo sapiens
agaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatg

SEQ ID NO: 13750 - DNA, 243 bp, Homo sapiens
  misc_feature 6: n = A,T,C or G
ggcggngggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 13751 - DNA, 181 bp, Homo sapiens
ggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagt

SEQ ID NO: 13752 - DNA, 104 bp, Homo sapiens
  misc_feature 20, 45: n = A,T,C or G
agtacttctagagcggccgngggcccatcgattttccacccgggnggggtaccaggtaagtgtacccaattcgccctatagtgagtcgtattacaatttcactg

SEQ ID NO: 13753 - DNA, 291 bp, Homo sapiens
  misc_feature 40, 68: n = A,T,C or G
gcgcgcctgcaggtcgacactagtggatccaaagaattcnttacgagatcacctgagattgggagttngagaccagcctgaccaacatggagaaatcccatctctactaaaaatacaaaattagccctgtgtgggggcacacgcctttaatcccagctactcgggaggctgaggcaggagaatcgcttgaacccgagaggcagaggttgcagtgagccgagattgtgccattgcactccagcctgggcaagaagagtgaaactccgtctccaaaacaaaaagtaaatacat

SEQ ID NO: 13754 - DNA, 400 bp, Homo sapiens
  misc_feature 14, 16, 208, 308: n = A,T,C or G
gcgcgcctgcaggncnacactagtggatccaaagaattcggtacgaggaggtcttaaggattgtcgacattatttcacagtggtagcactttccagatatcgagtaatctttacaaaagctaacataaatcagtttaaactcatttagatcccatttccactatgtgcagtttcattaccacactctggctggcctccttagggaggngggaggggcctgctgcaaactggcatgggtgcccatccacagctgctgagcaggctttatgtctcctcgaaagactggccatcgttactcatgtcatcgntaatggctgttactggtctaggctgagctcagagttccttcagcctggctgctgcttgtcaaggtggagggtcctgagcccagggagcaggt

SEQ ID NO: 13755 - DNA, 395 bp, Homo sapiens
  misc_feature 20, 174, 390: n = A,T,C or G
cgagaacatccggagcccanagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgngtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagancagcg

SEQ ID NO: 13756 - DNA, 286 bp, Homo sapiens
  misc_feature 2, 10, 41, 43, 75, 126: n = A,T,C or G
gngcgcctgnaggtcgacactagtggatccaaagaaattcntnacgaggtgaacatcccgtccttcattgtccgnctggattcccagaagcacatcgacttctctctgcgctctccctacgggggnggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaattgg

SEQ ID NO: 13757 - DNA, 399 bp, Homo sapiens
gcgcgcctgcaggtcgacactagtggatccaaagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattggtaaccttttcggcagcttttaataggaaagttaaacgttttaaacatggtagtactggaaattttacaagacttttacctagcacttaaatatgtataaatgtacataaagacaaactagtaagcatgacctggggaaatg

SEQ ID NO: 13758 - DNA, 300 bp, Homo sapiens
ttcggcacgagattaggacctgtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtg

SEQ ID NO: 13759 - DNA, 394 bp, Homo sapiens
  misc_feature 171, 213, 318: n = A,T,C or G
catgagtcattctagcccataactgaaccagaggaggcggtcttggaaacctccagcttacagtcgctcagtcagaaatatgtgaggatggatttacatttggcttctgaaatgggggcagttttgtgggactgagcctttaatttgtggaatctgatgttaattccaggnagatagtgtcagaattgaattgaattctaggacactcagtgntggtcagagtggggaaaattcgcacacaaggtatcagaagtgctctgtgtgagtgtagacaaactgttttcacaatgtgtgacccagggatgcttctgaaacttnatcacccatggatgtctttcatttatagagcttccttggcacagaatttaggtatcagatgctgactggtgattga

SEQ ID NO: 13760 - DNA, 400 bp, Homo sapiens
  misc_feature 5, 6, 41, 42, 72, 93, 96, 307: n = A,T,C or G
cttcnngggaaaaaacccctggtccctttgggcgcctgcanngccacactagtggatccaaagaattcgttncgagaaacatttcaggtacgnggnaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgngacattgaacatctcaccagcctggacttcttccgaaagaccagccgcagctacccagaaatcctgacactcaagacatacctgcatacatat

SEQ ID NO: 13761 - DNA, 388 bp, Homo sapiens
  misc_feature 8, 10, 40, 327: n = A,T,C or G
gcgcctgnangtccgacactagtggatccaaagaaattcnttacgagcttagacggaggagcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccatgctggccttcgtctccatctctggttgacgggctgtccgtgtgcctcctgtgtgtctgcagacaagtcttgctgngctttatttgtgaaactttaatgaggaaaaaacaaataataaatgttctcggttttggaaa

SEQ ID NO: 13762 - DNA, 123 bp, Homo sapiens
  misc_feature 4, 63, 100, 122: n = A,T,C or G
cccnggggctgcggccacttaaaacctcccgatctctttttgagtcctttattataagtagtngtagctgcgggagggggagggggagtgggcgggcagnggatagtaagacttactgcagnc

SEQ ID NO: 13763 - DNA, 237 bp, Homo sapiens
  misc_feature 103: n = A,T,C or G
gaaaatcacagcctttgtacccaatgacggttgcttgaactttattgaggaaaatgatgaagttctggttgctggatttggtcgcaaaggtcatgctgttggngatattcctggagtccgctttaaggttgtcaaagtagccaatgtttctcttttggccctatacaaaggcaagaaggaaagaccaagatcataaatattaatggtgaaaacactgtagtaataaattttcatatg

SEQ ID NO: 13764 - DNA, 135 bp, Homo sapiens
  misc_feature 109: n = A,T,C or G
agccactgagtatgttcattgccacccctgtccctcccctgggcacccctcactttccctgatcctgcaattaaagggttaatgtgtggcatatggaagggactcccangaccctgtgcccagcttccatgctga

SEQ ID NO: 13765 - DNA, 351 bp, Homo sapiens
cttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatgg

SEQ ID NO: 13766 - DNA, 321 bp, Homo sapiens
  misc_feature 119: n = A,T,C or G
atttctctagaggctggcaagaaccagttgttttgtcttgcgggtctgtcagggttggaaagtccaagccgtaggacccagtttcctttcttagctgatgtctttggccagaacaccgngggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgt

SEQ ID NO: 13767 - DNA, 398 bp, Homo sapiens
  misc_feature 11, 19, 31, 52, 57, 168: n = A,T,C or G
aaaaaccctgnttttttgngcgcctgcaggncgacactagtggatccaaagnaattntgcacgaggcaagagcaaggagaagaaacacatctggtttggagaaaccatcaatggtggcttccatttcagctatggagatgacaatctggctcccaacactgccaacgnccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgtta

SEQ ID NO: 13768 - DNA, 261 bp, Homo sapiens
  misc_feature 2, 87, 240: n = A,T,C or G
tngcgcgcctgcaggccgacactagtggatccaaagaatttggcacgagacgtggttccctccagcctccccaaaatcaaccctggngttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgnaaataaacaaatggatccctg

SEQ ID NO: 13769 - DNA, 304 bp, Homo sapiens
  misc_feature 17, 52, 83, 108: n = A,T,C or G
ggaaaaaccctgttttngcgcgcctgcaggccgacactagtggatccaaagnaaaaattgtgagaaacagaaatacttaaaangaggaataagaatggagatgttacntctggtagatgtaacattctaccagattatggatggactgatctgaaaatcaacctcaactcaagggtggtcagctcaatgctacacagagcacggacttttggattctttgcagtactttgaatttatttttctacctatatatgttttatatgctgctggcgctccattaaagttttactctgtgttgcactat

SEQ ID NO: 13770 - DNA, 400 bp, Homo sapiens
  misc_feature 3, 4, 30, 32, 33: n = A,T,C or G
canngcgacactagtggatccaaagaattntnnacgagctcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagacttg

SEQ ID NO: 13771 - DNA, 399 bp, Homo sapiens
  misc_feature 3, 27, 30, 343: n = A,T,C or G
gcnacactagtggatccaaagaattcnttncgaggcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctacttccaactcggacaaatccctcactgagctgnagagcaagttcaagcagggccaggaacaggacagccggcaggagagcaggctcaac

SEQ ID NO: 13772 - DNA, 400 bp, Homo sapiens
  misc_feature 2, 23, 62, 124, 302, 327: n = A,T,C or G
anggaaaatccactgttttttgngcgcctgcaggcccgacactagtggatccaaagaatttngcacgagctgacgtcaggagccaagatggcggcggtggtcgcactctccttgaggcgccggntgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggnattggatgctttaatcaagattaanaatgaagttgactctactttgaccttccgaagatcatgcagagaaggcatctgtggctcttgtgcaatgaaca

SEQ ID NO: 13773 - DNA, 336 bp, Homo sapiens
  misc_feature 191, 208, 263, 302: n = A,T,C or G
ggagcagtaaggcactacccagagagcttgctgctgcggccctgtcctgcggcctcaaagttcttctttactatatataacgtgcggccatacctttcttcgttgtggtggggatggaagagcagagggagcatggcccaggggtgttgaggccagcggtgagagccgtgttagccaagacatggaactgngttctcaagggttatgnggggcgtgggctctccatagtgtgtatgaaaagcttgttgactctagcggctcanagaggactttgctgggtttctttctgtgaatatctccgngctgaccatgctggaattggatgattctgcaatt

SEQ ID NO: 13774 - DNA, 299 bp, Homo sapiens
  misc_feature 88, 298: n = A,T,C or G
gaccagccgggcccgcagccgcatcctcagggcagggggcaagatcctcactttcgaccagctggccctggactcccctaagggctgnggcactgtcctgctctccggtcctcgcaagggccgagaggtgtaccgggcatttcggcaaggccccaggaaccccgcacagccacaccaaaccctacgtccgctccaagggccggaagttcgagcgtgccagaggccgacgggccagccgaggctaccaaaaactaaccctggatcctactctcttattaaaaagatttttgctgacagng

SEQ ID NO: 13775 - DNA, 397 bp, Homo sapiens
  misc_feature 2, 98: n = A,T,C or G
tngcgcgcctgcaggcccgacactagtggatccaaagaattctgcacgaggttctgaactttcctgttaccttttcagggctgacgtcacatgtaggnggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctga

SEQ ID NO: 13776 - DNA, 349 bp, Homo sapiens
  misc_feature 43, 105, 327: n = A,T,C or G
aatgcagcctggacgtcagcacagcatctttggagatccgaanaagatcgtcacagaagagtttgtgcgcagagggtacctgatttataaaccggtgccccgtancagtccggtggagtatgagttcttctggggaccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgngggtgtaaaagagagtcacagg

SEQ ID NO: 13777 - DNA, 307 bp, Homo sapiens
  misc_feature 4, 6, 33, 201, 288: n = A,T,C or G
cctnantgcgacactagtggatccaaagaattnttacgagcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgngttctttgcagggaatgaatactggatctactcagccagcaccctggagcgaggggtacccccaagcccacttgaccagccctgggnactggccccctgatgtcca

SEQ ID NO: 13778 - DNA, 192 bp, Homo sapiens
  misc_feature 84, 87: n = A,T,C or G
gttacctactgagtaggcggcgatttttgtatgttatgaacatgcagctcattattttgtggttctattttactttgtacttgngtntgcttaaacaaagtgactgtttggcttataaacacattgaatgcgctttattgcccatgggatatgtggtgtatatccttccaaaaaattaaaacgaaaatcaag

SEQ ID NO: 13779 - DNA, 398 bp, Homo sapiens
  misc_feature 3, 10, 40, 42, 43, 63: n = A,T,C or G
gtnaccactncactgcgacactagtggatccaaagaattntnnacgagcacccatttgccttnaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgt

SEQ ID NO: 13780 - DNA, 398 bp, Homo sapiens
  misc_feature 27, 52, 76: n = A,T,C or G
cgacactagtggatccaaagaattctncacgaggagagagagagagttctgnagatgtctattaggtccgcttggngcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatgttggtgctcctgtattgggtgcatatatatttaggatagttagctcttcttgttgaattgatccctttaccattatgtaatggccttctttgtctcttttgatctttgttcgtttaaagtctgttttatccaagactaggattgcaacccctgcctttttttgttttccatt

SEQ ID NO: 13781 - DNA, 369 bp, Homo sapiens
  misc_feature 2, 225, 329: n = A,T,C or G
cnacactagtggatccaaagaattcggtacgagcggagctgtacgtgaagccgggcaacaaggaacgcggctggaacgacccgccgcagttctcatacgggctgcagacccaggccggcggacccaggcgctcgctgcttaccaagagggtcgccgcaccccaggatggatcccccagagtccccgcatcagagacttctcctgggcctcccccaatggggcctncacctccttcaagtaaggctcccaggtccccacctgtgggggaagtggtcctgcctctggcgtggagcccacaagtttcccagtcgagtctgaggctgtgatgnaggatgtgctgagacctttggaacaggcattggaagactg

SEQ ID NO: 13782 - DNA, 325 bp, Homo sapiens
gccttccagaccatctctctgattctctttgggagatggggtctgaaagacaatgtcacgtagttttgggaaattctagaaagtgtgcttggaaacgtgggaagagctcttgcctagtgcctaaatgctccatttgcagctctagccaagtagatacttggtaggtatagagccgggtttgcatttatatcagcaaaacctatgtcagaattgaagaagtagtcaggaaaaagtgtcttggtcgcaggccggggaacatcttaaaagcaaacttctagcctgctgactcttggcaatgagtgttggatcctggctaaattgcctt

SEQ ID NO: 13783 - DNA, 324 bp, Homo sapiens
  misc_feature 2, 3, 4, 5, 7, 8, 162: n = A,T,C or G
gnnnnannttatgacaagacccaggacataggaggagatgcagggggagggacggcagggaagtcaggccccaggaactcacggacgggccccacctctggggccacgagccgccccccagctgcccagcgcatgcggacgctcttgcctcagcgctgcggntatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctg

SEQ ID NO: 13784 - DNA, 348 bp, Homo sapiens
  misc_feature 13, 61, 95, 110: n = A,T,C or G
atcatgtgtatgntctacattttctttatccagtccaccattgatgggcacctaggttggntccatgtctttgatattgtgaatagtgctgtggngaacatacaagtgcntgtgtctttttggtagaatgatttactttcctttgggtatatacccagtaatgggattgctgggtcgaatggtagttgtattttagttctttgagaaatttccaaactgcttttcatagtggctgaactaatttacattcccaccaacagtgtacaagcattcccttttctctgcagcctctccaacatctcacaagcaaagttttgaagggttcacaaagtaaaacaaactttagtg

SEQ ID NO: 13785 - DNA, 223 bp, Homo sapiens
  misc_feature 120, 128, 191, 212: n = A,T,C or G
ctgccgaaatgggcaagttcatgaaacctgggaaggtggtgcttgtcctggctggacgctactccggacgcaaagctgtcatcgtgaagaacattgatgatggcacctcagatcgccctntacagccnttgctctggtggctggaattgaccgctacccccgcaaagtgacagctgccatgggcaagaaanaagatcgccaagagatcaaanaaaaaaatttt

SEQ ID NO: 13786 - DNA, 395 bp, Homo sapiens
  misc_feature 56, 235, 322: n = A,T,C or G
gcacctttggacataggccgtgctgaccaggaattctttgtggacattggcccagnctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcagaagagaaaaagaaggattgatcagagcattgngcaatacagtttcattaactccttcccccgctcccccaaaaatttgaatttttttttcaacactcttacacctgttatggaaaatgncaacctttgtaagaaaaccaaaataaaaattgaaaaataaaaaccataaacatttgcaccacttgtggctttt

SEQ ID NO: 13787 - DNA, 319 bp, Homo sapiens
  misc_feature 20, 103, 253: n = A,T,C or G
gtccaccttccagcagatgnggattagcaagcaggagtacgacgagtcgggcccctccatcgtccaccgcaaatgcttctaaacggactcagcagatgcgtancatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgtngctgattttgaccttgtatttgaagttaactgttccccttggtatttgtttaataccctgtacata

SEQ ID NO: 13788 - DNA, 400 bp, Homo sapiens
tgcgcgcctgcaggtcgacactagtggatccaaagattcggctcgagggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcac

SEQ ID NO: 13789 - DNA, 400 bp, Homo sapiens
  misc_feature 8, 12, 190: n = A,T,C or G
ctggtttnttgngcgcctgcagggccgacactagtggatccaaagaattcttcacgaggaatctctacattaagaacttggatgacactattgatgatgagaaattaaggaaagaattttctccttttggatcaattaccagtgctaaggtaatgctggaggatggaagaagcaaagggtttggcttcgnctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggcta

SEQ ID NO: 13790 - DNA, 400 bp, Homo sapiens
  misc_feature 11, 15, 40, 41, 43, 44, 67, 96: n = A,T,C or G
gcgcctgcagngccnacactagtggatccaaagaaattcnntnngaggcagatcgagaacatccggngcccagagggcagcacgcaagaaccccgnccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgatcgatggattccagttcgagtatggcggccagggctccgaccctgccgatgtggccatccagctgaccttcctgcgcctg

SEQ ID NO: 13791 - DNA, 395 bp, Homo sapiens
  misc_feature 20, 60: n = A,T,C or G
ggaaaaaacctggtttttgngcgcctgcaggtcgacactagtggatccaaagattcggtncgagcagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaag

SEQ ID NO: 13792 - DNA, 218 bp, Homo sapiens
  misc_feature 128, 212, 217, 218: n = A,T,C or G
aaacaacaaagcataatatttcgcccactaagccaatcactttattgactcctagccgcagacctcctcattctaacctgaatcggaggacaaccagtaagctacccttttaccatcattggacaagnagcatccgtactatacttcacaacaatcctaatcctaataccaactatctccctaattgaaaacaaaatactcaaatgggcctngggcnn

SEQ ID NO: 13793 - DNA, 322 bp, Homo sapiens
  misc_feature 19, 21: n = A,T,C or G
tactattttcccattaatncnggactttataactttgtagctattaaaattaggaaatcctattatcaccattaaaaattatagatttgattatatcaaaacattgaactagagtaatcaatttagccttctcactgccttcctacttgaaaactgaatagctattagaacaggtatggcaaacaacattgacaaataccgttgtcaaccttaagcaacacagtgtgaaatgcttctctggacaatgagaggaagtacatatacaaaacagactaaaatagcatgcagtatttttaaatttatatatatatttttacatttt

SEQ ID NO: 13794 - DNA, 400 bp, Homo sapiens
  misc_feature 26, 48, 52, 192, 198, 255, 262, 279, 310, 322, 361: n = A,T,C or G
acactagtggatccaaagaaattcgntacgagatttatttgtgggttntttncccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgngaagtngggttaaatagtactagctagaaatacaaatttctggttatcatttctcttccctgnggcactngacattttaattgtctnaaagtttttgaagtacatcttctggcccctngagtactgccanaggcaaaagatgtttgtttcttattcattccacttttgnctcctgggatcccttctgtagcctaaagtatggctggga

SEQ ID NO: 13795 - DNA, 340 bp, Homo sapiens
  misc_feature 146: n = A,T,C or G
gtgacaaggacgcccgaagcacagtggacggtcatgaaggagcgggggtgtggcaggcgggtgacgtccaggagagggagcgcccctggctgcccctcggccgccgactggacgcgcgggccttgccagcgagcaccctcatcggnctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttc

SEQ ID NO: 13796 - DNA, 188 bp, Homo sapiens
  misc_feature 42, 44: n = A,T,C or G
tgcgcgcctgcaggcccgacactagtggatccaaagaattcntnacgagttgggccaattagggagtaaaaggagggaaggggcctatccattccattgtggaagctgggccaggtgccagggacactctccttcagggaaaatgttatgtggaggaggacgaataaatttattttgttttccaaata

SEQ ID NO: 13797 - DNA, 309 bp, Homo sapiens
  misc_feature 1, 11, 43, 46, 71, 148: n = A,T,C or G
ngggcgcctgnaggtcccacactagtggatccaaagaaattcnttncgagactatctgcactacatccgcnagtacaaccgcttcgagaagcgccacaagaacatgtctgtacacctgtccccctgcttcagggacgtccagatcggngacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 13798 - DNA, 107 bp, Homo sapiens
  misc_feature 2, 11, 27, 44, 45, 57, 61, 62, 64, 72, 99: n = A,T,C or G
angtacaacangcttagagaagcgccncaagaacatgtcatgannacctggcccccngctnnanggacgagnagtatcggagacagtcgtcacagtggngcagaggg

SEQ ID NO: 13799 - DNA, 271 bp, Homo sapiens
  misc_feature 24, 35, 70: n = A,T,C or G
acactagtggatccaaagaattcnttacgaggccngttgtcagaagaatccaagcaggcattggcttagntgtaagggctttaggatcaggctgaatatgaggacaaagtgggccacgttagcatctgcagagatcaatctggaggcttctgtttctgcattctgccacgagagctaggtccttgatcttttctttagattgaaagtctgtctctgaacacaattatttgtaaaagttagtagttcttttttaaatcattaaaagaggctt

SEQ ID NO: 13800 - DNA, 348 bp, Homo sapiens
ggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtg

SEQ ID NO: 13801 - DNA, 350 bp, Homo sapiens
  misc_feature 63, 139, 256: n = A,T,C or G
ctcctcctctgtcttttggagaaccagggctcttctcaggggctctagggactgccaggctgnttcagccaggaaggccaaaatcaagagtgagatgtagaaagttgtaaaatagaaaaagtggagttggtgaatcggntgttctttcctcacatttggatgattgtcataaggtttttagcatgttcctccttttcttcaccctccccttttttcttctattaatcaagagaaacttcaaagttaatgggatggncggatctcacaggctgagaactcgttcacctccaagcatttcatgaaaaagctgcttcttattaatcatacaaactctcaccatgatgtgaaga

SEQ ID NO: 13802 - DNA, 173 bp, Homo sapiens
atttttatgagataccaaatatccttgacaagaagtacagattctgggacatgtggcattttgtgacttggaaagcctcaagaaatgaagtgttcctcccaggaggcagaggtttcagtgagttgagatcgtaccattgtattccagcttgggcgacaagaaggaaactccat

SEQ ID NO: 13803 - DNA, 111 bp, Homo sapiens
  misc_feature 105: n = A,T,C or G
agtacttctagagcggccgcgggcccatcgattttccacccgggtggggtaccagggtaagtgtacccaattcgccctatagtgagtcgtattacatttcactgnccgctg

SEQ ID NO: 13804 - DNA, 181 bp, Homo sapiens
agatcactttctgcccagcaattagagagcaagctgatgataataatattgcttatatggttcttcacagtcttaaagcaacttcatgcacacttctaaaaaaaaaagaaaagaaaatacttggaatgatagtaacactatatattgaaccttataagatgtagctttaaaaataaaagta

SEQ ID NO: 13805 - DNA, 395 bp, Homo sapiens
  misc_feature 35, 42: n = A,T,C or G
gtgcgcctgcagggcgacactagtggatccaaagnaattctncacgagaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctg

SEQ ID NO: 13806 - DNA, 320 bp, Homo sapiens
  misc_feature 27, 40, 49, 145: n = A,T,C or G
ttcggcacgaggccgaaatgggcaagntcatgaaacctgngaaggtggngcttgtcctggctggacgctactccggacgcaaagctgtcatcgtgaagaacattgatgatggcacctcagatcgcccctacagccatgctctggnggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttc

SEQ ID NO: 13807 - DNA, 135 bp, Homo sapiens
  misc_feature 20, 37, 49: n = A,T,C or G
ggggaatatacacattgctnttatatttaatactttngctgatgctttngaaaatgtttatgccacagaatttgctaatatattgtaatcacattccttaggaggactttggtaattggttttatgcattgatgg

SEQ ID NO: 13808 - DNA, 230 bp, Homo sapiens
  misc_feature 4, 7, 18, 148, 176: n = A,T,C or G
gttntgnttactcctaanaggcttctttgcgtattttctaaatgtaatatctcggggaaaatattagaaaagcacgtattagctgaagaatgtaacttgtagtccagctctgcagcttccttaaacttaagaaaaagattgggccagngacaagaatttaaagacaatgtccaagntgacaattatttttctatagtccatacaaattaaataatctggcaactctggca

SEQ ID NO: 13809 - DNA, 350 bp, Homo sapiens
  misc_feature 120, 234: n = A,T,C or G
caaaaaaaaaccctctttttctggggaaaaatgagcaagtaacaagtgacgtcaacataagaaagattttctaataaatgggaagacctagtcaatggttagcttgcatcttaatgtagncagtctcctgccctgagaagtttcgaacattcccattagtttcaaatatggactttcccttggaacttagagaaaatgtggataatatgaccttacaggcctttatgaatttgngggttcaatattttaacattcacagatagttggcatgtgaactgagagtatggaggaatcaccaggtaaactggttaaagaagaagacggaataaccaggttagtaaaataaactg

SEQ ID NO: 13810 - DNA, 283 bp, Homo sapiens
  misc_feature 161, 178, 240, 242: n = A,T,C or G
accccatagaaagttcctggtagaaaagatggcagatcagcactattgtaatgggagccctgcctgcaagatcttggaattatgatttctacccatttatatcaatgtcctttgctgtctctcagacatgatgctggggtattgcagctaggacaagccanagctcaaaggtgctggnttttattcctgtgtgcttactcccaacactgaattattttttgtgtgtgtatatgtgcgtgngngtgtttttagtgtcctgtattttttttttaggtatatagag

SEQ ID NO: 13811 - DNA, 226 bp, Homo sapiens
  misc_feature 61, 70, 187, 211, 220, 222: n = A,T,C or G
gttgcaccgtggaggccacagggagcagaaacatggaatgccagacgctggggatgctggnacaagttgngggactgcatgctactgtctagagcttgtctcaatggatctagaacttcatcgccctctgatcgccgatcacctctgagacccaccttgctcataaacaaaaatgcccatgttggtnccttttgccctggaccctgggaantttctgggnantttt

SEQ ID NO: 13812 - DNA, 327 bp, Homo sapiens
  misc_feature 6, 209, 217, 287: n = A,T,C or G
cttcangggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatnatgaaggnggaggagatcgcggccagcaagtgccgccggccggctgtcaagcagttccacgactccaagatcaagttnccgctgccccaccgggtcctgcgccgtcagcacaagccac

SEQ ID NO: 13813 - DNA, 316 bp, Homo sapiens
  misc_feature 22, 26, 65: n = A,T,C or G
gtacaatgggactcaactgctnattnttcttttatgcctctcttttctctagttttacactgtantctagagagacagacaaagatgaaagaaatacacacacacgcacacacagagagagagagagaaatagggaagatctataggaaattattatgcctaactgattgtagtttgagttttgttttccttttaaaaactaatttagagagaaaagaagacaaattctatcatataagaatattactctatctcgttgattttacttagtttgaaactgataggtgctgaattaaaaattctggaagatgtactg

SEQ ID NO: 13814 - DNA, 345 bp, Homo sapiens
  misc_feature 285: n = A,T,C or G
tctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctnctcatcctactctcatcacacactggatgccgtatggatccctctacaatgtactacatg

SEQ ID NO: 13815 - DNA, 334 bp, Homo sapiens
  misc_feature 42, 43, 193, 287, 328, 330: n = A,T,C or G
gcgcgcctgcaggcccgacactagtggatccaaagaattctnnacgagtgggcggatgttgtgaaccgggtcgcggcggccgaggctcgggcctccaggaccactggctgcccatgagagacgaaggatggcatccaagggggccggcgtgtctttctcccgcaagagctgtaggctgacctcagatgctganaaatccagggtcacagttactcgggaggctgaggcaggagaatcgcttgaaccggagaggcggacgtttgcagtgagcccgaggtcaaaccagngcactccagccctgggccaacagagcgagactccatctgananagga

SEQ ID NO: 13816 - DNA, 380 bp, Homo sapiens
  misc_feature 2, 39, 41, 42, 98, 111, 164: n = A,T,C or G
gngcgcctgcagggcgacactagtggatccaaagaattntnnacgagggcacacagctggggctgcccccacccgaaagaccctccacgctcgtcctntacagagtccggnttcgggaagtgccgggtgctcctgggccctgcctggctccctacgacctttgngctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctg

SEQ ID NO: 13817 - DNA, 303 bp, Homo sapiens
  misc_feature 20, 256, 289, 291: n = A,T,C or G
ggagcttcggcctatgcctntgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgangccaacacacagggcaagtggtgtcgatggagncnaagcgctgaagg

SEQ ID NO: 13818 - DNA, 396 bp, Homo sapiens
  misc_feature 16, 155, 349, 361, 366: n = A,T,C or G
gcgcgcctgcaggtcnacactagtggatccaaagaattcggtacgaggaagtgcacaggactgcgccactgtctggtgttcactgctgggcctcaggggtggctgggggcttccatgtacagacagccagggctccacgaatgccaggggctggnggaaacacccctagctgctctgttgcccatgctggtagctgaagtgttgatgggctgttttccccagcagagtcaagtatgaaaagagcaatggtgggaaaaatgctgaaattactggagatttcttcccttctaccctggaatttattcttatcagaaaaaaaaaagcaaacatggtgacaagccctggctgngctgtgactcanatganctaatactttagtgtctcttgagaagtaca

SEQ ID NO: 13819 - DNA, 106 bp, Homo sapiens
  misc_feature 20: n = A,T,C or G
tatgggtgtcttacgtctgnccatccatctgtccgtggtcagaagtggggtcagtgtgtgagtgagagcaggagtatttatgaaaataaaacgtcgtttttcctgg

SEQ ID NO: 13820 - DNA, 367 bp, Homo sapiens
  misc_feature 3, 43, 45, 67, 68, 70, 71, 94, 295, 299, 327, 356: n = A,T,C or G
tgngcgcctgcaggcccgacactagtggatccaaagaaattcntnacgaggtaagaccatcactctnnanntggagccgagtgacaccattganaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctngaantggagccgagtgacaccattgagaatgncaaggcaaagatccaagacaaggaaggcntccctcctgac

SEQ ID NO: 13821 - DNA, 427 bp, Homo sapiens
gaggcattgaggcagccagcgcaggtgcttctgctgagggggcaggcggagcttgaggaaaccgcagataagtttttttctctttgaaagatagagattaatacaactacttaaaaagtatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaa

SEQ ID NO: 13822 - DNA, 680 bp, Homo sapiens
ggaaatgattttttttaaagatattagagcattcgagctgttttgtaggtagaggggaagtaacatggagaaatgaaaacatggacaaatagagaaaaatataacagaaataatggaaagtaaaaggcctcaaatgagataggagggagggtggcccaagagcacagggaaagccagcaggtagcctccaacggggcttcctctcagactcagactggacctaatggtacaaggttagaataaaggaatagagagtatagattaaaggaatagaatatggtatgtagtctatatgtcttacttttttaagagaatcagtctctttgtagcctattgccagggtaaaccttattgcagacttcatattctaattttatcaaaagcaaacacattaattattttctaactctaccaaaacattcatgcacattcatttacgtttatctatgacagacattgtgcattcctacttgtgttggcttttctttggagtggcacactttattcaaaaagacagattggttagtataaatggtataagttgggtaatataattaaatctaaaattataataatagtaaatattattataaagaaatcaaaactgctttctcagaaaattgtcatcatatttcatgatgagtttctcccagcatgaaagatgtaggtttagggacgtg

SEQ ID NO: 13823 - DNA, 543 bp, Homo sapiens
agatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatccttgagatcccagggaaaaaaaaaa

SEQ ID NO: 13824 - DNA, 306 bp, Homo sapiens
gaagttacttaatgttgatctatcccttggggaaagtaaaagtgactgtgagtggtgccattgtgtgatgtcagcatgacgttgttttgaatgtggtattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgg

SEQ ID NO: 13825 - DNA, 289 bp, Homo sapiens
gaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaaaaaaaaaaaaaaaaaaaaaaaaa

SEQ ID NO: 13826 - DNA, 579 bp, Homo sapiens
ggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactgggtgacagacaaaatctgttttaaaatcatatccagcacaaaaactatttctggctgaatagcacagaaaagtatttaacctacctgtagagatcctcgtcatgggaaggtgccaaactgtttgaatgggaggacaagtaagagtgaggccacagttcccacacacgagggcttt

SEQ ID NO: 13827 - DNA, 397 bp, Homo sapiens
gcaagttgctttgtgtgacttaaaaagaaaaagaatcttggtccgggcactgtggctcatgcctgtaatccttgcactttgggaggccgaggcgggtggatcatttgaggtcaggagttcaagaccagcctggccaacatggtgaaacccagtctctactaaaaatacaaaaatgagctgggtgtggtggctggagcctgtaatcctagctacttgggagtctgaggcaggagaatcgcttgaactcaggaggcggaggttgcagtgagctgagatcgcgccattgcactccagcctggccaacaaatgaaactctgtcttcaaaaaaaaaaaagtctcttatgagattttgaagcattttgttcagagccatgaccccaaaaaaaaaaaaaaaaaa

SEQ ID NO: 13828 - DNA, 312 bp, Homo sapiens
cttcataatgaagttaaagtgagtatactgtggagaggacttccaaatgtggttacctcagctatatcactgcccaacatcagaaaacctgacggttatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgag

SEQ ID NO: 13829 - DNA, 636 bp, Homo sapiens
atctttaagctggtgattctcaccaacacatctaagcatgaaagaaataaaaattataagataaaaaggaaagaaaactctcagtacttaaagatgatataattacatagaaaatcaagaagattccatggataggcttcccaaaaaacaatatgtaacataccagcaacaaatggtaagaaaaacacgttgtttttttttaaagtacattttcagtgacattaaataataaggattcaggaatacaacgaatataacaaaaatgtaagatatctagggatgcgtataacaaaaaaattataaagcttcatttaaaacatttttaaacaaaataagtagaaagtaataccatctttatggaacagagtcagtattataaatgtgtcagttttcttcaactggtccatagacaacacaattttaactaagattccaattgggatttctgtggaacttgatgagttagggccaaaagtaatcaagatattcatgaggaaggataacagaatggcaaaacttgctttaataatttgtgcagggatagacaaatactgtacacagtctctcaatagggagatcaaaaccaaattcacacagacatgaaaagttgatttatgacagatgatgtgcagtccc

SEQ ID NO: 13830 - DNA, 359 bp, Homo sapiens
attgcagtataacttaagctccttttctctttagtccacttttgattgtaattttatggtataggattttgaatcttctattttaggcttgtcagtcttggagttcctatcttccattatccctaaatattgataaactcccaggcaccaaagaaaacatttgcttaattgtctgaaaagaaacaagagaaaaacactggtatttttatgtctgtattcaatatggtataaaatataaaaactatattttaacttagtgaaatattttactatttctctacttcagacaaaatgttgcatccaaggtacatcaagtgaccatttgccttgaaccttgatttcactttgttttttttttt

SEQ ID NO: 13831 - DNA, 248 bp, Homo sapiens
caatctcttgcactcacaagcttgtcaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcata

SEQ ID NO: 13832 - DNA, 315 bp, Homo sapiens
gggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccgtgttattc

SEQ ID NO: 13833 - DNA, 585 bp, Homo sapiens
ggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtcttgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccctggagtaagaaggtagtggcatgggtggagtgtgtgttctttctcaaatctatatgatgttaataaacacttcgtagca

SEQ ID NO: 13834 - DNA, 504 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctcttttttttctggaggctggcacctgattttgtatccccctgtagcagcattactgaaatacataggcttatatacaatgcttccttcctgtataatctctgtct

SEQ ID NO: 13835 - DNA, 536 bp, Homo sapiens
ataggaaccacacttgaagaactagttctacaattcagctgtatgttgtaaaggagtcaagtcaatgaaggagttataaagagttgctgaaaaatggagtaacagtgtatgggacttcacatcagttctccttattgattgttagtttgatccctcttgttcttttgttgtaaacattttctataattaggaaatgccatttaagagtgagagaggtatatatctatgagccattgtgtttggtgttttacaagaactttaccatactggtgtgtagtccattctgtacagtttaaaagtgattcacgatttgcaggctttttatcagatcacaaaaaaatcagtctttaagcatttgcttggtaaggtttcttaagattaggtttataatacaaccatctgtaatgtatctctcgtttgagcttgtgggccatacaattcattaactagatgaatacattgtggacagcatcctcactacccctctctactcactcacaaagaaccatgatacactggaatgttttctctgggaa

SEQ ID NO: 13836 - DNA, 303 bp, Homo sapiens
tgctgaagcacaactgacttcacttgctaaagccttatttacaactgtgcttggggcgaacacataagattatagtctttaatgcaacagcaggacctgtgaggataccaaacaattcaaagatgcacaggaggccgaaactaataaccaacggattcgcagatctcgctgatcggatagtggctgccataccaccagctagagatatacacttggctgacaataaactaaaaaaaatcccttcaggactaccataggcgaaatacctccagacagtctcccttccttataatccatttgcga

SEQ ID NO: 13837 - DNA, 133 bp, Homo sapiens
attgtttcgttttgcttattatccaaaaagtttatgatttttgtattacttagaactgtgttatttaacttccacatatttggacattttccagagatctttctgctattgacttctaatttaattacattat

SEQ ID NO: 13838 - DNA, 199 bp, Homo sapiens
ttccaccctagaccccacaggtcagggtcagggactccccaccttttatacagtggggagagagtagaacctgtgctctcaaagtcagagtgggcctgcactagaatcccagctttgccagataccatttggtcttgacaacttctttaacattttctgaacagtaacatagcatataaaaaaaaaaaaaaaaaaaaaa

SEQ ID NO: 13839 - DNA, 589 bp, Homo sapiens
  misc_feature 16, 17, 18, 21, 25: n = A,T,C or G
gagggaggtattactnnnccnaagngaagaccccggcctttttgggcgagatttccctcagggactgccaccttcccttacggaagtacatctagatgtcaacataatcagcagagttgatgcggctagcggtgaaaggactgaataattaaggctaagatagggattgagtttcaacagcatcgtctgctgtttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttctgattcgggtgtagagtcttttcaagcaacccggtccagtactgggagatacagccatccaccttcagatgtgtctacgtgcgctctgcattcaactcggaaactataagtaattctcagagaaagccctcatttttataacctggcaaaatcttgtaatgcatggctaaataaataaataaaaagctagatactggaaacctact

SEQ ID NO: 13840 - DNA, 646 bp, Homo sapiens
cctactcacatagttgttaacaagactcactttcctactggctgttggctggacacttcagctcctggcctcttcacagataaggctgcttgcaacatggcagctttgttttcctacagcaaatcatgcaagagagcaagaacccaaggcagaagtctcattcttgtagagtctaatcttggaagtgacacattatcacttccaccatatgctcttggtcatacagactagactcactctggtagagtgtgaatgggactccgcaagaggtgaggcgcattgggggctgcctttgaggttggcaaccacaattaccttgatctcctagttgttaaatgatattatttcatccatctcttcaatttactttgtaaaagtttctcatttacagtcacggaatctgtaatgatccgggaaaatctacagacgcctaggtcagtgagccttgctcatgcatttaagctttgtaagtgccaaaacaatttattaaaagtatattgaatctttcgcaaagtttatcaagtaaggtatttggtaaggtagaacccccagggcatgggctaagggactttgggggccccaggacccttcagaaaagccatgaggcaaaactgtttcataagccgaaccaaaaatttttgacttt

SEQ ID NO: 13841 - DNA, 259 bp, Homo sapiens
ccggaaagatatcggcatctatatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatatcctgtaaaggttacaagcctgcacaataaaaatgtttaacggttaaaaaaaaaaaaaaaa

SEQ ID NO: 13842 - DNA, 533 bp, Homo sapiens
cgaaatacccagtttgttcagtatgagtttttagaattattttaaattgcaattatgcacaggcaataattttctttactgatagagttttatcagtagtaaagaggaggataaagaagagaatgaaaagcaaactgagaatttaaaatctgattcctaagcagaaaatacatttctgacccagcagttgtataaatacagttgtataaatagagcagacaagaaatactgcttaagttttagatttcttttaaaaaggaataacaaaaaagtttgtattcatataataaaataatttgtgtaattggaaacagaaatttaagatatattgcaatgggatatgatgacataatttctacaatcatgacaaaatatgtacagtgactcacttaagaaagtttcctcttttcttttccagtatcttaattaacccacaagtaagggtttgaaataccatggaaaaaaaagatttattatttttaggcctaatttgataggaaataaaggattaattttcaaaaaacttttcaacc

SEQ ID NO: 13843 - DNA, 290 bp, Homo sapiens
tgaggcagccagcgcaggggcttctgctgagggggcaggcgttagcttgaggaaaccgcagataagtttttttctgtttgaaagatagagattactacgactacttacaaaatatagtcaataggctactaagatatcgctaagcgctaagtctacaacgtaattttaatagcttaagattttaagagaaaatatgaagacttggaagagcagcatgaggaaggaaaagacaaaaggtttctaacacatgacgcgaggctgaggtgaacttcttcatgtgcatctaacca

SEQ ID NO: 13844 - DNA, 372 bp, Homo sapiens
gcatatttcatctgtactcaatattcacttttagtgaagtatattttgttatgttgtcataatcaccaatttactgttttaaagaatagaaggccaggtgcggtagctcacgcctgtaatcccagcactttgggaggctgaggtgggcagatcatgaggtcaggagatggagaccatcctggctaacacagtgaaaccccgtctgtactaaaaatacaaaaaattagccggacgtggtggtgggttcctgtagtcccagctactcgggaggctgaggcaggagaattgcttgaaccagggatttggaggttgcagtgagctgagatcgtgccacagtactccagcctggcgacagagcaagactccatcccc

SEQ ID NO: 13845 - DNA, 445 bp, Homo sapiens
gagactctggataggagagcactgaggaagcatctttatgttcttgcaaaatcctgagttggtcacgggtttttatcattcacttcatgttcttaactcacagtggaataaagaaatggtgtgaacaacggttttgaaatgttatacccatctctcagctgctcagaatctgtttcaaagatagtgaacaattagaagggtgggttactcagaatcagtgcccacatatatttcacttaacagaatgaatcatggccactcaaaggcagcagactttccatgtactcccagcctgccacgtgtgtagtatgaacccaacattctcatgaacaacagtttctcaaaaacttggcttttaataggtagcaattgcctgtgtgtgtgtgtgtgtgtgtgtgtgtgtgtgtctgtgtgtgcatgtgtgtgttttgtacacacacataaa

SEQ ID NO: 13846 - DNA, 431 bp, Homo sapiens
gtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttaaaaaa

SEQ ID NO: 13847 - DNA, 197 bp, Homo sapiens
gatgcactattttttttaatatatacacttataccagaaacagttatttttttcattcatttttaggagtgggtacgtttgtattcaagtctaaaaagatgctgactaaatccatcaatagaagggaataagataagtgtagtggttaaaagagacattgttttatgaaaaggctagaatgaccaaaaaaaaaaaaa

SEQ ID NO: 13848 - DNA, 458 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattcaaattctgctgctgctttt

SEQ ID NO: 13849 - DNA, 107 bp, Homo sapiens
gatttaagaagcatcctctgccaagacaaaaaggaaagaagaaaaagggccaaaagccaaaatgaaactgatggtacttgttttcaccattgggctaacttggcggc

SEQ ID NO: 13850 - DNA, 549 bp, Homo sapiens
attgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaaagaaaggcaggattacatccttttttttttttt

SEQ ID NO: 13851 - DNA, 375 bp, Homo sapiens
gaacaagaactctgagtatcacttcttcaggcagtgctgtaagctgttcaacaattcctccagaactggtgaaacagaaggtgaaacgtcagttgacaaaacagcaaaaatcagctgtcagacgtcgattgcagaaaggagaagcaaatatatttaccaagcaacgtagggaaaacatgcaaaatatcaaatcaagtttggaagcagctagcttttggggagaataatatatttaggatcttggatatgtttaatatattttttaaagttactgtaattcctttttgagccctcatttgtcttttttgagccaaggctatcatatattaataaataaaccctctttcatccaaaaaaaaaaaaaaaaaaaaaaaa

SEQ ID NO: 13852 - DNA, 585 bp, Homo sapiens
gaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtatttcgttgctatagtagtttgctaaaagatgatgaaaatgcagaatgtcttttaaatgtttttaaatataaacaaatatt

SEQ ID NO: 13853 - DNA, 699 bp, Homo sapiens
agaatagtataatgcataaacatgtgacttaccctcaaaatgttcaagtctgtataatgttgaactcattgcacaccatttcatgtccatgttttttcttcatgatttttagaaaaggcacttcatttttggctaaaggaattttttttaatactgaaatttgagtaattgattctgttaatccagcatatgctcctattaaataaattgtatacaattcagtgacttcattagagatgataagccacatacttaaattttgtgatactccctgataatctgcattcattgataattgagacaaaattaatcatatataatcaagcaaaaatgcgaacaaaattagctgtcagaaaagcattatccagtctttattttttagttaactttagatattttaacaacacataaaatgagtggtagggtatatttgtattttactgtataggacaccttcagataaattctaaaaataatttgcattcatgtaatgctttcacacaaagtaatggccaaactttagggtcagtttgcctgctcatacacatgcagaacaaatttaagatgggttaggctccaaatagaaagaaaattcctaataaaaaactatcagatggtaaaaggattatttcagaaaataaaactaataaaatagaactattctggtaccaaaaaaaaaaaaaaaaaaaaaaaaaaaaa

SEQ ID NO: 13854 - DNA, 717 bp, Homo sapiens
attgaaaaaaggttagacaaattgctaactagaacaaccagtttagagaagaacataaatgacgtgatggagctgaaaaacatagcacaagaacttcgtgaagcatacgcaagtatcaacagctgaatcgaataaacgaaagaaaggctatcagagattgaagatcaacttaatgaaataaagcatgaagacaagattagagaaaaaagaatgaaatggaatgaacatagcctccaagaaatatgggactatgtgaaagaccaaacctacgtttgattggtgtacctgaaagtggcggggagaatagaacctaattgaaaaacacatttcaggatattatccaggagaacttccccaacctagcaaggcagaccaacattcatattcaggaaatacagaaaacaccacaaagatactgctctagaagagcaaccccaagacacgtaatcgtcagattcatcaaggttgaaatgaaggaaaaaatggtaagggcagccagagagaaaagtaggttaccacaaagggaagccatcagactaatagcatatctctctgcagaaaccctacagcagaagagagtggggaccaatattcaacactctaaagaaaagaattttcaccagaatttcatatccagccaaactaagcttataagtgagagaaataaaatcctttacagacaagcaaatgttgagaaatttgtcacacaggcctgcc

SEQ ID NO: 13855 - DNA, 433 bp, Homo sapiens
gatccctcgaccgctcgcgtcgcatttggccgcctccctaccgctccaagcccagccctcagccatgggatgccccctggatcaggccattggcctcctcgtggccatcttccacaagtactccggcagggagggtgacaagcacatcctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaatttttttgggcaaattta

SEQ ID NO: 13856 - DNA, 506 bp, Homo sapiens
atatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattggtaaaaaaaa

SEQ ID NO: 13857 - DNA, 491 bp, Homo sapiens
tggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgccgaacac

SEQ ID NO: 13858 - DNA, 283 bp, Homo sapiens
ggctgaaagtgatactcctgcctcagcctgtcgaagtagctgggattacaggcatgcaccaccacacccagctaataaagcatttttagcagaggcagggtttctccatgttggacaggctggtcttgaactcccgacctcaggtgagccgcccacctaggcctctcaaagcgttgggattacgtgtgaagccacagtgcccagcccgaaaagaatatctttaagatatctgtaagtggtatatccctgccgacagaagtacgggaaggcgaagaaaaagaat

SEQ ID NO: 13859 - DNA, 409 bp, Homo sapiens
ttcgctaacgcctcccgctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgttttgggaccaagaattcctgaaagttgaccaaggaacactttttgaactcattctggctgcaaactacttagacatcaaaggttgctt

SEQ ID NO: 13860 - DNA, 490 bp, Homo sapiens
cctccctggctcctgagctgctaaggtacctccccctgaggtcagattcttccgcaccagtcattttaatccattttgatgtcagagacctgtgtgggactctggaaattcagaaggtaattgagtatgactcttttcccaataactgctgtgaaaaaacagaacagatgaattttagaagaatgtctgaaattcaagcatcctgtgaggtatctccactggtgagttacttacagctagtcagcaaatgaaaccagagtcgcccaccagtatcctggtgagtcatcgccagcctgaattattaagaaagggatggctgcccgctggcatctttcctttcatctgctgctgtcccttgtcctgtgacatccgtgttgccatcctatcagaattggcaacatcacctcatgggtaagaaatcaattcctgctggggtctctacaggctgcttcttgttgggaactaaaggaagggagctttaattataaaa

SEQ ID NO: 13861 - DNA, 101 bp, Homo sapiens
tctaacactgtaacataagcatcactggggaacagcctttgcctgcttgtttattgctacatccttaggcccttacacagtgcctgaaacataagggatgc

SEQ ID NO: 13862 - DNA, 377 bp, Homo sapiens
caatgctgccaagagcaacctgtttttacaaagttaattttggacatttaaggacaaatatggtgccagtggataacctaaagaactcggaacaattaggaagagcaaactgtaaacccttgaaatctgtaattctttccttgatgactaagacgcaaaattggctctttggtttgaaattactgcagtgattctagaactaaatagatggtgctaagtttataaatcagtgcacacacatcgttattattgccaaaggatctcagtataaatttctacattccaaaattatgccacaaaaggcagtatgaaatgtgggttgaatataaatactgtacatagtcagaagcataataaacactccaaaaaaaaaaaaa

SEQ ID NO: 13863 - DNA, 349 bp, Homo sapiens
actcagcactttgggaggctgaggtaggaaggatcacttgatgccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaaa

SEQ ID NO: 13864 - DNA, 654 bp, Homo sapiens
gggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaacctatacttaatatagtaaatctaagtaaacatgtattactcaaagtaatatatttagaattatgtattagtataagatcagaattgaatttaagttgttggtgacatctgcatcatttcataggattagaacttactcaaaataatgtaatctttaaaaatataaattagatgacaagtgggatcataaattaaacgttaatgggttc

SEQ ID NO: 13865 - DNA, 476 bp, Homo sapiens
atatgtgataagacaattatatctagaatgtgtaaagaagtcttacaactgaataataaaaatataaatattccaataagaagggaaaataggattttaacaggcctttctctaaagaagacatgcaaatggataattagcacatgaaaaaaagctgagggtcattagtcattagggaaatgcaaatcaaaaccatagcatacccgttcatacccataacaatacctaaagtaaaagggacagatgttagtgtctgtgaggttggagggaaactggaaccctcattcgctgcttgtgggaatgtgaaatggtgcagccactttgaaaatgagtctggcagttccttaaatgaataaacaagattaccataggactcaataatcccactcctaaatatatgcccaggaggaatgaaaacatgtttacacagaaacttatacatgaatatttatagcagcattatttataatagtcaa

SEQ ID NO: 13866 - DNA, 532 bp, Homo sapiens
ataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccggtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactgggttgcatggaaatcagccaagttttataatccttaaatct

SEQ ID NO: 13867 - DNA, 255 bp, Homo sapiens
gggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaacgtgggccccacatgatagaactaaattcagatatcattaaataaactcttgtacactatgccgtaaaaaaaaaaaaaaaaaaaaaaaaaaaaaa

SEQ ID NO: 13868 - DNA, 429 bp, Homo sapiens
ggatttccaggcaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcattaacaccattacctcccaagaaagaaaatgatgaaatgcccacgtgtctgctgtgtgtttgtttaaagtggctctgtatactgtgaagaagttgacattgatgctgtac

SEQ ID NO: 13869 - DNA, 366 bp, Homo sapiens
ctcgagcaattgtcctacctcggtctctttattagccaggattacagatgcgtgccactgtgcctggctattagaagatgcactttttaaagaggtgaaggggagcagggtggagtagtggtattgtgacagttacctggaaaacttctaactcctcttcctaaatttacctcttacagagtgtcctgtattaggtagcctcagtttccttcccatgtaatgcatacatagttatttgttattattgcccttagcaggtaaggctgtattaagcaatttatgtgagagaagaaagggagatgacatgattggtggggagccagtttagttaagtttctttggacaaataggacttttgagaaatct

SEQ ID NO: 13870 - DNA, 432 bp, Homo sapiens
atgagtagtgtggaattcaggtagtaaatatgaagctagggtttgaaattgataatgctttcacaacatttgcagatgttttatgaaggaaaaaagttccactcctaaaataacttctccacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatgcaaaatgttccttttgcttttagagtaatttttgactcccagatcagtcagagcccctacagcattgttaagaaagtatttgatttttgtctcaatgaaaata

SEQ ID NO: 13871 - DNA, 376 bp, Homo sapiens
cattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttgggtatggtagtgtgtgggtctcttttggaatttttttcaggtgatttaataataatttaaaactactatagaaactgcagagcaaaggaagtggcttaatgatcctgaagggatttcttctgatggtagcttttgtattatcaagtaagattcattttcagttgtgtgtaagcaagttttttttttagtgtaggaggaatacttttccattgtttaactgc

SEQ ID NO: 13872 - DNA, 313 bp, Homo sapiens
tgtagcctgctgtcggctgctgctttttacaaatacagttttcttggaacaaagacatgtccattcatttgtgtattgattatcgctggttttatgctataatggcaatattaaatagttgaaatgaaggctgcatggcacacaaagcttaaaatacagttggacccttgaacaacatggtttgaactgcatgattccacttatatgtggatttgtttctataaatatgtcagatgaattttaggagatttatgagaatttgtaaaaactcacagacaaaccatatagcctagaaatactaaaaaaaaaaaaa

SEQ ID NO: 13873 - DNA, 574 bp, Homo sapiens
gtaaaatatacctttggtaaaaggattataaggaggcctaagaatgtacatttttacctacattaaaaagttaaaaagaattattgttttgaaggtttaagcaagttttaaaacgttaattgtaaagaaaatgctgtttgtaaacatattagctaaagttaaagaggtatcatccagtttttctgtgaactggacagtaaattaaaagcataacaggtttttcttaaagcaccaacctgctctttagtaaaaattatagaaggttaaagagtctataaaatctttcctaatagtcaaacattaaaaaattaagtaaatatgtttacaaggttttattaaaattaggtttaacattaataacacactaatataaagataaaatttagcttatctggtataaaaatcatgtgagaagcattgttaaatgtaaaatggtatttggctttcttggttaaaaactaataaaaataggttctaaaggaaatttctcagtaaaaaagcactaaggactataaagtccactgccaaggtccccatatttaaaacaaaaggtcaatttctaaaaattatatac

SEQ ID NO: 13874 - DNA, 548 bp, Homo sapiens
gaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtcccatttttaacctcttgaaacaaaattattctcagccaagaattttgtatccagtaaaactaagcttcataattgaaggagagatagtctttttcagacaaacaaatgctgagagaatttgccactattgagccagcactacaagaaatgcttaaaggagttctaaatcttgaaacaaaacctcaaaatacaccaaaatagaacctcattaaagcgtaaatctcacaagacctataaaacaataatacaatggtgaaagacaacgtc

SEQ ID NO: 13875 - DNA, 247 bp, Homo sapiens
gatcactgtaataggtactttgacacattattttacaaaatctgcaagtcatattacatgattttcattttatagttaaagaaactgagattcctagagtagaagttatacaatgtcacataataaaaacaaagccagaatttgaacccaggcctccctgagtggatgtactattttttttagttcattattgtgttttattattggaaaatacactgaaataaatatcctatgagcttacttgtgg

SEQ ID NO: 13876 - DNA, 370 bp, Homo sapiens
catagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagt

SEQ ID NO: 13877 - DNA, 375 bp, Homo sapiens
actaaacaactctctgaaatttctcaagcaccaagagaaacatcattttagcaaaggccaggaggaaaaataggaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatcctttatggaaaccatttttttaaaaagtgaatgtacacaaatccacagaggactgtggctggacattcatctaaataaatttgaatatacaaca

SEQ ID NO: 13878 - DNA, 449 bp, Homo sapiens
aacacaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattcccccgg

SEQ ID NO: 13879 - DNA, 386 bp, Homo sapiens
gaaacagacttacacttcttcagaagccacatttggccgggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaactcccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgacca

SEQ ID NO: 13880 - DNA, 551 bp, Homo sapiens
acggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcatctagactccttgggaccgtgagttcctagagcttggctgggtctaggctgttctgtgcctccaaggactgtctggcaatgacttgtattggccaccaactgtagatgtatatatggtgcccttctgatgctaagactcagaccttttgtttttgctttgcattttctgatttataccaactgtgtggactaagatgcattaaaataaacatcagagttcctcc

SEQ ID NO: 13881 - DNA, 155 bp, Homo sapiens
ggcgcaactcttagtcgcgggccgactggtgtataaccgtcactcgccgaagttccttgagtcatggtgccagcctgactgagaagaggacgctcccgggagacgaatgaggaaccacctcctcctactgttcaagtacaggggcctggtccgca

SEQ ID NO: 13882 - DNA, 343 bp, Homo sapiens
gaggcattgaggcagccagcgcaggggcttctgctgagggggcaggcggagctagaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagataaaaacatacttttagaagaaaaaagataaatttaaacctgaaaagtaggaagcagaagaaaaaagacaagctaggaaacaaaaagctaagggcaaaatgttcaaaaaaaaaaaaaaaaaaaaaaaa

SEQ ID NO: 13883 - DNA, 321 bp, Homo sapiens
aacagctaaggactgcaaaacccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccccaaa

SEQ ID NO: 13884 - DNA, 737 bp, Homo sapiens
ctacttctagctcctaggcagctacctttgctgtgtccgtatccattacaaagatgccagtcttttaaagataggaaggagttgtttgcaaatggcatttaaagaatagatagagagttagtgggaaaaaattaggagagtggtagtggaagtcaagaaaagcgtttcaagaaggatggactgaccggcgaacagtgccaaatctgaaggggtcagctagatagggactgaaaatagccattgaattgaataaggcgcagtcactatgaaaagggttgtttcagcagattgtcaagggcttaaggatattaagtatttttcatttttcaagctaaaaggggagctcatttcagtttattaaatttcatcttgcagacttcaagctaacttctacttcatgattttgaatgtcaatagatctgatctgaatatgaaattctgaggaagatttttccttatagccactaactgtttattaattattcctcaacatacttttgaaaaacatttggaaatgggttttgtatcaaaaggtgacctccaagaatttcctggggtaggagggaagattaaaagaactgtgaagccgtttggaaaatgggaggaaatttggaaaaagaaaccgaatccccattgggaaaccttgggggtggttttcccaatggggccccaatttttacccaaaattccaagggaaaaaaaaccagggggaggggggtttccttaaagaaaaaggg

SEQ ID NO: 13885 - DNA, 610 bp, Homo sapiens
aaagaagagaggaagattttagagtggacttgaaacttggaagaaaggaatgtcttaggtttttattctaatgataggcccatgtcagctccaccttggtgactaaaccctgatagaaaagacataagggtctttctgttatgaaatgagaccactgggaaatgaaggacaatcttgcaaaaaagatagccaaaagggggaaaccctaaattttgagtatatactctgcccaaatctctggctaattcacaaatcatagatgtgcaggatagacttcaccaaaagttaaaatatttgtatgagatttgagctgacatccaaaagaaggtgtgcagttcttgcaaatgaagctaattgccctctagaactcaattctttttagaggactataacagaatccagagtctccaccatgtaatatacacaatatccaatatacaatccaatattatgcaacatacaagggaccaaggaaaatttaaaacattttcaaggggaagggaaattgatcaatttgagaataacccccaaggtgaccctttttgtttggaggttagcaagataaagaaattttaaagccgctatttataatttttgctcaaaggatgta

SEQ ID NO: 13886 - DNA, 515 bp, Homo sapiens
tgatcgcgcgccatcatggctcggcatgcatgctcttcgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaa

SEQ ID NO: 13887 - DNA, 401 bp, Homo sapiens
gctttgaacgtgctataggaccttctcaaacacacaccatcagaattcaatattcacctgccagactggcttatcaagacaaaggtgtccttcataatgaagttaaagtgagtatactgtggagaggacttccaaatgtgggtacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagcaactaatgaagaaatgaataataaattttgacactgaaaaacattttattaataaagaatattgacatgagt

SEQ ID NO: 13888 - DNA, 228 bp, Homo sapiens
caaagccatgggtttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaa

SEQ ID NO: 13889 - DNA, 140 bp, Homo sapiens
ggaactgttcagcaggctgatgaataagatctaagagttttctggctacagaaagaagatgccagatgacacttaagacctacttgtgatatttaaatgatgcaataaaagacctattgatttggaaaaaaaaaaaaaaa

SEQ ID NO: 13890 - DNA, 365 bp, Homo sapiens
gcttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgacgcagtccctgccccccggtttggcagtgaaggaactgaaatgaaccagacacactgattggaactgtattatattaaaatactaa

SEQ ID NO: 13891 - DNA, 173 bp, Homo sapiens
gtttctgttaaattcaatcatgtgactcaaagaaatgagtgtctgtggatggagagacagaatcataattctgttactgtgtacacatattgggaatgcttttgacacctgcagtcattctgcatgataattctaatatcatttctctttgtccaaaacgcatggtttataac

SEQ ID NO: 13892 - DNA, 334 bp, Homo sapiens
tttattttaggtatccaaataggccagatgttattctctttatgaatatagctatctttataacaacttatcttccaaattcattggttataaaaaatgtggttgttaatgcaaaaaaaaatggtcagttagcaatgcacttaataacccattaaatttaaagagattaaaaatgtataaactttaatatattgtaacttagtttaattcagtttagtgaacatgagagctattatgtacacatgagtggctgggtgctggaaatacagagtgattaagacatacgtcctatctctagggatgtatcttattgcaagttcaaatccaagtaagg

SEQ ID NO: 13893 - DNA, 447 bp, Homo sapiens
aatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcatcataaccttagatgggggtgtcctggtacatgtgcagaaatgggatggaaaatcaaccaccataaagagaaaacgagaggatgataaactggtggtggatgcgtcatgaaaggcgtcacttccacgagagtttatgagagagcataagccaagggacgttgacctggactgaagtt

SEQ ID NO: 13894 - DNA, 523 bp, Homo sapiens
gaaacctggaggatggaaaggtgcaaaaatctatcaccagcaacagaaggtgcagaccgtgttggtggcggtaattttgtccatcaaatgaatatgtgtgaaaacattcccttcttcggccctacaggtcagaatggcggcagcggagcatcgtcattcttcaggattgccctactggccctacctcacagctgaaactttaaaaaacaggatgggccgccagccacctcctccaactcaacaacattctataactgataactccctgagcctcaagacacctcccgaatgtcttcttattccccttccaccctctcctcttccaccctccgtggatgataatctcaagactcctcccttagttactcagggggccgaggcagaaaaatcactgaaacccaagaggcagaggttgagtaagctgagaacaggtcattgcactcaagcctgggcaataagaagaaatctgtgagtggacaaaagaaaaaaatcaaaaaacaaaacaaaacccacactccaaaaa

SEQ ID NO: 13895 - DNA, 380 bp, Homo sapiens
gtacacatgctatcttgatacctctatatacaatgtgtagtcaccaaatcagggtaattgggatattcatcacctcaaacattttcttttctttgtgttgggaacattacaattcttctagctgttttgaaatacattgggaggctgagatgggtggatctcaatgtcaggagtttgagactagcctggccaacatggtgaaaccctgtctctactaaaaatacaaaaattagccaggcgtggtagtgtgtgcctgtaatcccagctactcaggaggctgaggcaggagaatcgcttgaacccaggaggtggaggtttcagtgagtcaagatcgtgccactacactccagcctgggtgacagagcgagactccatctcga

SEQ ID NO: 13896 - DNA, 623 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtaggggttataataatgttaacatggacatgatcttccttataattctactttgagtgctgtctcatgtttgatgtatctgagcaggtgctcacaggtagctctaggagggctggcaac

SEQ ID NO: 13897 - DNA, 421 bp, Homo sapiens
atgtcaatatttagtaaagcttttctttttttaatttccaggaaaaaataaaaagagtatgagtcttctgtaattcattgagcagttagctcatttgagataaagtcaaatgccaaacacgagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcctcctacctcctcctaatctacatttgagtatgggaacttatgtcatcctatggttgaat

SEQ ID NO: 13898 - DNA, 618 bp, Homo sapiens
attctaactaagcgaaacaatgcacagcgtcaacagatcaaagcagcatatctccaggaaacaggaaagcccctggatgaaacactgaagaaagcccttacaggtcaccttgaggaggttgttttggctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacacagtacagtaagcatgacatgaacaaagttctggacctggagttgaaagtgacattgagaaatgcctcacagctatcgtgaagtgcgcacagcaaacc

SEQ ID NO: 13899 - DNA, 327 bp, Homo sapiens
tttgcacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagcctacactcctgggctccaaaagctatcccagttgcctgtttttcaaatgaggttcaaggtgctgctttgcatgcctgccaacccatggaagttgtttcctacctccttt

SEQ ID NO: 13900 - DNA, 483 bp, Homo sapiens
gaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgacttttacagatttaaaaaaatcttttcagtgacctttctttttaatgtaaatacaaatttaaacctaggcttaaaaggcgtttcccctttcacccaagtgagtcacagttcgagcaaaatcaatgatccagaatgatcgtgggtaaaaataactcaaagtgtttccaagggggagtggcaagcaaaaaatacattgataca

SEQ ID NO: 13901 - DNA, 281 bp, Homo sapiens
tatctcagatgtttgctgggaacagtgataatgataatgagcatcatattgaggtagaggaagaggactggttagtgggtactggtttagaggtactttttaaaggaagcataagcacattttgggcatgcaaaatattaagctcagagcttagacacttggtaaaaaacaagggtctgtgtgaggagagctctgagaaaagggttgtcagacagaagccaaatttctcaagaaggacctctaaacagcattaagaaaaaaaaaaaaaaaaaaaaaaaaaa

SEQ ID NO: 13902 - DNA, 512 bp, Homo sapiens
gccttccttgaagtgagccttggaaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcattgtgaaaatgagcttcccattactggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattgggatttaattactctgtcaaaatcccgataaagcaaggatttaaatgc

SEQ ID NO: 13903 - DNA, 291 bp, Homo sapiens
gtagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggc

SEQ ID NO: 13904 - DNA, 109 bp, Homo sapiens
gtgggaaacagatctaaatctcattttatgctgtattttatatcttagttgtgtttgaaaacgttttgatttttggaaacacatcaaaataaataatggcgtttgttgt

SEQ ID NO: 13905 - DNA, 201 bp, Homo sapiens
ggtacaaggcatttctgacattttataaacctacatttaaggggaatttttaaaggaaatgttttttctttttttttttgtttttcgagggggcaaggagggacagaaaagtaacctcttcttaagtggaatattctaaaaagctaccttttgtaagtgccatgtttattaccaaaccattccaagttttgcattgatgtc

SEQ ID NO: 13906 - DNA, 490 bp, Homo sapiens
ggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaaggaatcacaaaagcaattaagagagctcaaataatggggtttatgccagttacatacaaggatcctgcatatctcaaggaccctaaagtttgtaacatcagatatcgggaataaattctatcacgttaccactaataaacttattttacaggaaaaaa

SEQ ID NO: 13907 - DNA, 576 bp, Homo sapiens
gatttttgtataaggtgtaaggaagggatccagtttcagctttctacatatggctagccagttttcccagcaccatttattaaatagggaatcctttccccatttcttgtttttgtcaggtttgtcaacgatcagatagttgtagatatgtggcattatttctgagggctctgttctgttccattgatctatatatctgttttggtaccagtaccatgctgttttggttactgtagccttgtagtatagtttgaagttagatagcgtgatgcctccagctttgttcttttggcttaggattgacttggcgatgcaggctcttttttgttttcatgtgaactttaaagtagttttttccaattctgtgaagaaagtcattggtagcttgatggggatggcattgaatctataaattaccttgggcagtatggccattttcacgatattgattcctcctaaccatgagcatagcagtctattaaaaaacagacaaaactaaacttgttgctaaggtgtgtatatcaagtggctgaaacaataaagaaaagcaaggaacttattactgaaagaatcggg

SEQ ID NO: 13908 - DNA, 628 bp, Homo sapiens
atagcaccattctaacatgagcttgaggtcctcaccaaagtcttgatgaaacatactttttaaagaaataattttttaaaaccccacttggctcaaagacattgtccagagctccagctttggacttttacctgtagtcagtcatacaattatctggggttatacttgttaagtcagtatttaaaaaaatgaaacaccctgattttgttcacttttgtttttatataaaagaatctttacagtcaacatgtacttctagatgctgtattgaaattgctggcagagtttattctatacaaaatgaacaatctggccccttgttttatttgtaaaggttcaatgtatctatgcctgcctacctcaatctgcaagggagtgtcagaaaggcccgcattcgccaagccgtgagttatcgctaacttttcagatgtgttaatgaatgtggaacaaaagcagttgtgtttaaaagggaaaaggaccatcaaaataactttattatagtagcaggcgtaaacactaaactgaataatccaaattgtgtcaaaaataacctactagagacgagcttctagaaaacctatgtgaactgctctgaagctatcatttaactataaattactgtgtaaaa

SEQ ID NO: 13909 - DNA, 243 bp, Homo sapiens
gggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttt

SEQ ID NO: 13910 - DNA, 159 bp, Homo sapiens
ggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagaccccc

SEQ ID NO: 13911 - DNA, 606 bp, Homo sapiens
atatttttgtgccgttttacaagacgtgcgcgagttaaatttaagctaagcggcaaaaaacttcgacaaaagagtcaaagtttgaaagtttgtaaagttaagttacggtgagttaaggttaattactgaagaaagaaaattgttaaatgaatttagtgtggcctactttaaatgtgccatgtttgtaaagtctacagtagtgcacagtaatgtttgaggccttcacattcacccaccactcacttagtgactcacacagagcaacttccacccctgcaagctctattaatggtaagtgccctccctatacaggtgtactattttttatcttttatactgtttggttttttttactgtgctttttctattttagatcaccagtaccattgtgtgacagttccacagtaagtatcagtacagtacattctgacaggttatagcctagaacgatagctctaccatgtagcctaggggatagaggtatgcatctacgttgtgaagtcactctatgttgccacgcaaacactattctagatgattcatgtaaggccattctgattcgtgttggagactaacattcaggacttacaaaaaaaaaaaaaaaaa

SEQ ID NO: 13912 - DNA, 541 bp, Homo sapiens
aaaacacagaagccaaggaaggctctttctcatagttgaaaagaaaaagcagcatagatttggtgctcttctgtaagggtgaggctcatctccggctgtctgtgaggtgtggcgaattccagaggcttggagattgagtaggggtcactggttgctgatggctgccttgcatgtccccttattcaggagcaattaaaatatgaattgtgagcatcttcactgtttttaaaaagttgacctaaaaaagcttccatggatcaaattctgcagtcctttaagtgaacaaggcagaattaatatattggttttagaaagccagttcatttaaaatgaagcctggattcctcattaatctggggggttaaaccaaacagtgtagcttcttcagaacaataaaggtaatatatggaaatatggagcagcgggattgcctagttctgggaagatcctcagcctttccttgtgaaaagtacaaagtctttaggaggagctccctattcatttttttgggggggggggaaaaatttactctttcccgaat

SEQ ID NO: 13913 - DNA, 650 bp, Homo sapiens
  misc_feature 325: n = A,T,C or G
tctagcgactgcatggggtatagtctgtgtattcaagataaagaaggcttgtcagctttggatcttgcaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggcctggagggcgattaggacatgnagatgaacagacatgcttggccctcggcttgtggaaggactgaatggcataattgttcccaagtggcagctgctaaggacatactgttgtattaactgaagatggatgtgtttatacatttggctaaaacatttttcatcaattaggaattattccaccgccttccagttgtaatgtacccagacagatcaggcaaaatttctgaaaggaagggcaatcattggcggttcacaggcagggttcatacagtcctattggacttagagaagcctgtttccacttatggggacctaaaaggggggaaaaatttgggttgggttgccta

SEQ ID NO: 13914 - DNA, 341 bp, Homo sapiens
ctatccagcgaactccaaagattcaggtccactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttgggatt

SEQ ID NO: 13915 - DNA, 369 bp, Homo sapiens
atcacctattggcttaacagagatcgaaatggacatgaatactatggcgattactaccaacgtcactatgaggaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgtcaaa

SEQ ID NO: 13916 - DNA, 250 bp, Homo sapiens
gtataactgatgtttgacaaaaatgtgaaagcaattcagcaaaaaataaggatagtcttttcaacaaatggtagaagagtagttatgtattcataggtcaaaaaataaaccttgtcctaaaccttacactatgtatgaaaattacttaaaatggatcatagacttataagtaaaacttttagaagaaaacattcaggacctagggctttgtgaagagtttttgggtaagatactgaaagcgcaatccatg

SEQ ID NO: 13917 - DNA, 298 bp, Homo sapiens
gggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaattttaacacccatagtaggcctaaaagcagccaccaattaagaaagcgttcaagctcaacacccactacctaaaaaatccctaaaaaaaaaaaaaaaaaaaaaaaaaaa

SEQ ID NO: 13918 - DNA, 547 bp, Homo sapiens
gcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatctgttaatgtcattgccaaaaaataaataaaagctagatactggaaacctaactgcaatgtggatgttta

SEQ ID NO: 13919 - DNA, 511 bp, Homo sapiens
agtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagtacacattttaattttcctccaattaaaatgtgcagtattttcagtgtcaaatatatttaactattaggagaatgattccaccttt

SEQ ID NO: 13920 - DNA, 424 bp, Homo sapiens
actggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttctaccaattccaatttcaaaatgtctcaatggtgctataataaataaacttcaacactctttatgataata

SEQ ID NO: 13921 - DNA, 206 bp, Homo sapiens
tctgtcacggatgtcgtcgtggcaacgttgctggtgacagcaaagatgacccaccaatggaagcagctggcttcactgctcaggtgattatcctgaaccatccaggccaaataagcgtcggctatgcccctgtattggattgccacacggctcacattgcatgcaagtttgctgagctgaaggaaaagattgatcgccgttctggt

SEQ ID NO: 13922 - DNA, 443 bp, Homo sapiens
ggactcggcccgaggtgcagcagtggtaccagcagttcctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgttctatttcagcagatcttttctacctactttgtgtgatcaaaaaagaagagttaaaacaacacatgtaaatgccttttgatatttcatgggaatgcctctcatttaaaaatagaaataaagcattttgtt

SEQ ID NO: 13923 - DNA, 654 bp, Homo sapiens
gggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaaagctagatactggaaacctaactgcaatgtggatgttttacccacatgacttattatgcataaagccaaatttcagtttaagtaattgcctac

SEQ ID NO: 13924 - DNA, 516 bp, Homo sapiens
atacagaaccaaccacacccttaattatgctggaaggagtcaaaccttggcttcacttagtacataattaatacaatttaccaggttttacattaaagttaaaaattgttaggaattaccattataacatgtaatagaaactactggaaatagatttacatgcaacgtatgtaagagcagtaaaatgtgtttttaataaaagattataagaaggtgtggaaatgtaaattctttcttagggttaaaggattgttttgaattatataagataaaattcaaagttcaagctgtggaaaggctgtaaaaattcatcttgcaaaagaaattctgtgtgtgaacatattaactaaattcaaaaggttattatatggtttttatgtaaattgagcattgaaataaaagcacaagaagatactcttaaggtactaatctgctcttagcaaaatttgtaaatggttataaaaggttttgctttttaaatttttgaatcatttggcaaaataaataacttatggc

SEQ ID NO: 13925 - DNA, 350 bp, Homo sapiens
aaggtaatgttgcctggggcttaatccatctgccctttgggcaaggttggggcaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccctctgccccagggctcttcagaaagcatctgcatgtgaacaccatcatgcctttataaaggaccctta

SEQ ID NO: 13926 - DNA, 445 bp, Homo sapiens
aatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgcccgtggcacgatggcgaggaagccagcccaaggaaacactgaaaacacatatcacgccaatgccgtgtggtttttgtttgaa

SEQ ID NO: 13927 - DNA, 439 bp, Homo sapiens
gggatctggttttggtctgactttgctaattcaaatagaatttgtttttgttatggcttttagatgatccctatttcacagaaaatgtctacagtctatacatttttatttgtgccatggcaaattcaattcagttttactttttaaaatttttcacaaggaagagtaaaaatgagaggttaaaaaaaatctgtatttcatgaaaggcttgtatgacgacaacgaagctattgaatttgggatgtgaagaccctcttttcaacacaatgagaacagtttgttgttcagattagactaagttcctgaaatttaccaaaaccccaaacaaaatattagcaaatacaatacagcaatatataaaaagaagaatttatcttgacgaagtgtggtttttacaaggtacagaaaattggttgaacattcaataaacaattatatc

SEQ ID NO: 13928 - DNA, 269 bp, Homo sapiens
gggggcccgaagcgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattaatcaaaaaaaaaaaaaaaaaaaaaaaaaaa

SEQ ID NO: 13929 - DNA, 548 bp, Homo sapiens
ggatcggaacggagaacagaattggtaacaacatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacaggaccaggccttggttaggctgagctcccagcaggacaccgcctgcagaaaggacctgccctgatatgtccctttcccaga

SEQ ID NO: 13930 - DNA, 488 bp, Homo sapiens
taatacaacacaggtcgtcactagagccacaatctggtaaataatgctttatgatcgattgtaaattatatgggtctgataattgggacttaatgtaaccacactcaccgtgtctccctttggctttcttgaatgctgtaacggtggctctcgtaacagattgcatgtgagtgccagcaccatccccgaacaaatacagtccctctctgtgcacgactctcaggtatgtttctctgccagtcattccgtttgaggtgctttgtagacagatcctttaaaaaaccacattttagaaagatagacaatttcgaggtagtgcctccaaatcaagggcttataagctgtctttttaaatagggttgctattgactgtgctttgtgggacctccaacctttaaaatgataaggctcaagaagtgagaattgattaccagactgctcctgaaattgctggacctgtggaaaaaaaaaaaaaaaaaaaaaaaaaa

SEQ ID NO: 13931 - DNA, 316 bp, Homo sapiens
aaccatttaacaaggagggggatctgtttcctaccttctttgcatgctgtgcattgctgtggtccagaaatgccaaacctttttaaagatggtgcaactttgagccttggcttgactatacaggccttgaacttcatggcatatcaactttgccatatctgcaggagagctgttctataagaaatagctcagagttgcaatatcacatgtgaatgatacggtaacttttaagaaatgtctgtattgtatttgaagactgtttgccataaatctgaaatctgaacctatgtatttcaatttggtatgctaaaaagtc

SEQ ID NO: 13932 - DNA, 251 bp, Homo sapiens
tgtctacctatttaaaaaagttaactgtggaacagcagtttaggtttttcagggggtattccagaaggcattgttatcacaggagatgacagctccatgcatgttattgcctctgaagaccttccagcgggacaagttgtgaaggtggaagacagtgatattgatgatcctgatcctgtaggcataggctaatgtgtgtatttgtgtcttagtttttatcaaaaatgtttaaaaagtagaaaaataaaagc

SEQ ID NO: 13933 - DNA, 346 bp, Homo sapiens
atcacttttgaattgtgaaaccctgcagatgtttgagtagaaagaagtaaactttggtcaaataataatatttaataaagatattaaagacaacggtgctgttcttttcatttttatatgctaatatcaagacctcattgcttatgaagctatctataatcatgcagggttgtaacttggaacttttgaggataataaacggacgagaaaaaaaatgattgaacccttgctctgtaacttttccttcagggccaaacactgaactgaagattctaggcgtctagggcacatgggttccatcacaactactcaactctcccattctgaaagaagttacaagaaaata

SEQ ID NO: 13934 - DNA, 412 bp, Homo sapiens
accccttatgatgagatgactagcagatgcattgggatgctagctagatcatacaacccttattttcaaaaatttctacaaacaaaaagaaaaagcccaaaaaaaacatttcagctgctggaacagtatggacactgatcactgagtactggatgtgccttgaggcattgtgtttttgtgtaacgagattgccatactgatagtttgcttctctttacatgggcattagattaggtttcagataggagactccacataaatcacatacaaaatgtggaagataggctggttgtggtggctcatgcctgtaatcccagcactttgggaggctgaggcgggcagattgcctgaggtcaggagttcaagaccagtctggccaacatggtgaaaccccatctctcctaaaaaaaaa

SEQ ID NO: 13935 - DNA, 510 bp, Homo sapiens
acagtagtctatagttaggattaaaataggatctgaacattcaaaagaaggctttggacatcaatagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtacattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagattcaaacttgtaattgtgggtaaatagtcattgtatttcct

SEQ ID NO: 13936 - DNA, 317 bp, Homo sapiens
gtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatag

SEQ ID NO: 13937 - DNA, 628 bp, Homo sapiens
ggaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggactacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtacaatcctctaatatgaaatgtggaaaagaatggagagcagcagtaaaagaaatatctagtgaaaaaacaggaagcgtatt

SEQ ID NO: 13938 - DNA, 302 bp, Homo sapiens
aatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgt

SEQ ID NO: 13939 - DNA, 484 bp, Homo sapiens
atttcatctctaatattttggatggggaaccatccaaagcttctgggcgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaaagcttttctgcccacctcttggggagaagggaataatttagttggtaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctaccaaa

SEQ ID NO: 13940 - DNA, 582 bp, Homo sapiens
gctctcgctgcagtcagagctccaggtctggttcttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtagtactgtttctaagccagacctgatcacctgtctggagcaaggaagaaaacctttgaccatgaagagaaatgagatgatagccaaaccctcagtgagcttccttcaagttcacagtgagagccaaagtcctcttcatgacatataagagactgcacagtgtggctgcttttccataatttttgggacgcacaaatgtctgcatgattttgagaaactaaaattactctcaaagttctctttttgcatcagatctgaaatgtctgagagtaatagtttctgttgaatttttttttgttcatttttctgcacagtccattctgtttt

SEQ ID NO: 13941 - DNA, 363 bp, Homo sapiens
agcatatagaaatataaatattaaataatccagaactacataaaaagcaagtccaattcattcaacatacttgtgtattactcactgataatatccatgaattggactatttttctccaactcacctgtctcatgctacacaggagcctattttgaatgtttcctgtgggaaagaaacctcatgcattcatttcaattaaggcagtgattctcaactgggggattggttgtatagtttataatagtaatggtacagagaatttctactatacagaaatgttagtgatagaatccttaatgatgttaaactgttgatggaagtatgtcatgtctgtcaggattctgagatggaaaaagattggc

SEQ ID NO: 13942 - DNA, 402 bp, Homo sapiens
gggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggcacaaaagttccctctcactttcagtaaaaataaataaaacagcagcagcaaacaaataaatg

SEQ ID NO: 13943 - DNA, 367 bp, Homo sapiens
gaggactggactcagcactggcacagaggcagcacagctatgtgggaagaacacaggctggtctgcaggtctagatttggatcctagctctgttacttactactttgtgactttgagcaaattcacgtctctgaaaggtcagttttccttctgtaaaatatcccaacttctgttgtagaattattattataaataaatagtaacatatatataatagtaacatatataaatagtaacatatatgtatatatatgtgtgtgtatatatatgtgtatctacatatgtgtgtgtgtatatatatatatatatatatatatatgtatataatgtctacctgtattgttgctaggggctgccctggactatg

SEQ ID NO: 13944 - DNA, 666 bp, Homo sapiens
caagactgatttttaaatctgtgtcttgtgcaacactctaatggcagaaagggctttagagtttcaacttaagcttttgtgggagaacaaactaactgagctgcctctcacctaggatactcctacagcccaaactacgagttcaagagaattctatcttggaaaggactgagtcttattagactgcttatccctaatactctgcagagtcatccctcatttattttttaatgaaatttgacaaaatatgtacactaagtctcctgtagaatggccataatttgtgcttaggaatgcataattttatcaggatctctgtaattagatattgtgcaatagaataaaaagcaaatactgtgtgtcccatggcaacctcggcctttagtatctcactatctttgagataacaaaggtttccacaagacacacgtaccacatgggatttttaagtagacatccaggaagagaacgaaagttcccctgttggttttcccctatttttaagtgtgagtgtagaatgtgtgttttgttctcttccttttaaattgcctcctggaattgggttgttttcctttatctgtccggactgtaaatgtgggatatgaaggtcatagtcctgtagaataacgtcagtgcttgagctagtgtttggtgtggaagtaccta

SEQ ID NO: 13945 - DNA, 354 bp, Homo sapiens
agaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatcaaagaaaaaaaaaaaaaaaaaaaaaaaaa

SEQ ID NO: 13946 - DNA, 412 bp, Homo sapiens
ggctatgggcagtatttacaggctgtatatgttattcacataatcaggtatcagttatattgccagaacatgatacaaattgattgagacacttacttatcatggcattgtttatattagtgaaaatagcagccaggtgcagtggctcgtgcctgtggtcccagcactttgggaggccaaagcaggctgatcacttgaggccaggagttcaagatcagcctggccgacagggtgaaaccccatctctactaaaattacaaaaaattacccagacatggtgccctgcacctctagtttcagctactcgggaggctaaggcaggagaatcacttgaattcagaaagtgaaggttgcagtgagctgagatcgtgccactgcactccagcctgggcgacagagcaagactgtctca

SEQ ID NO: 13947 - DNA, 365 bp, Homo sapiens
agaagaaacagacaaagaagaacctgcatccaaacaacagaaaacagaaaatggtgctggagaccagtagtttagtaaaccaattttttattcattttaaataggttttaaacgacttttgtttgcggggctttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatacga

SEQ ID NO: 13948 - DNA, 387 bp, Homo sapiens
gagttgtgcacagtgggatgtaaatatcgccttcctctccctatatccctcccatgaaaaatggcttcctggccgggcgtggtggctcacgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaaggggcggaggttgtggtgagccgagattgcacctttgtactccagcctgggcaacgagcaaaaaaactctgtctcaacaaaaaaaaaaaaaaaaaaaaaaaaaaaa

SEQ ID NO: 13949 - DNA, 284 bp, Homo sapiens
agttgtagaaatgattcctcaaataaaattttactaggaacttaaatacatacaacagataaaagtgtcttatctatttaaaagtgtttgaggaacaaaaaatggagaaggcaccttctttatctagactccaactcttcagcctcactctgggccgccttactcttcccttagaggtaacccatgaggtacctcagctgaagtgttaaggtgtcatggagagcgctgaaaaccagagatctacccaaatattctgctaagcaagaaaagaaagatcccattgc

SEQ ID NO: 13950 - DNA, 502 bp, Homo sapiens
gttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttg

SEQ ID NO: 13951 - DNA, 531 bp, Homo sapiens
ggtctttgttgctctgggagaggggactcctggaatgtgtctgtgaataaagactagccgaaggtgcgaagtgactagacgggagcaaaggaggaaaactagggaatgggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtgggagcaggatgt

SEQ ID NO: 13952 - DNA, 629 bp, Homo sapiens
atcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggtttttgtgatgtatgaaacttgtgttttttatatataaatgagtatagttagtgttgt

SEQ ID NO: 13953 - DNA, 174 bp, Homo sapiens
acgtagcacgtttacctcatatgtgtgtgttcatgcttacttgagatcttgtatatgaaagcaacctgtgaattataaaactcatatgagttattaatgccattattaaaagtataacaatgccatgaaaatattagtgtttcattccaataaaaaaaaaaaaaaaaaaaaaaa

SEQ ID NO: 13954 - DNA, 699 bp, Homo sapiens
tgattttgagataacatgcatccattctgagatgtctaaatagtatgtaataagaaattagaactgtgatagaggtcaatataggacataggaatcagggaaccattcacatactaatgacagtttgatagtgctttagtgggagagattgtgatagagaatttagagaagcatgatggaatcttgtagagaagctaattctgtcacattcggaggaagagtccaagagaatacctagtgaaaaaggaaaacaaggaaataataatttcaggaaagttaagattgaatgtagttttaggaatgttggagaatgttggggaagaggggcgggagtagcaatgcttaacaatttaatattctgtagtgtggttgagaagtaggcagttactaatcggatcagaagccagactgcatgactacggacacataaagggacacattaagatggtaaattatgtgagttgcagagctaagataattcgtattggggtatttccacttttacctaatattgacatataaaccccatggggggatgtttattatgggatttggaatttgaaaatgtatttggtaagaaaattatttttttaccaaaaaccaatttataggctggatattcaatcttttccatattcttgggggggggaaatttaaaggggtttaaagggtaggattttttttttaggaggggggggg

SEQ ID NO: 13955 - DNA, 109 bp, Homo sapiens
ggaacaaagataatgggggagggtcgatttcagagacatgtaaaataaatgcagggattccagtaactcatagttccaaagagagacacatgaaataattttacggagg

SEQ ID NO: 13956 - DNA, 619 bp, Homo sapiens
ccactattgcttccagcaatgtaccttcgagcgctagctggctcggctaatgaaactccggaaataccggacaacgtgggagattggcttcggggcgtctaccgctttgccactgataggaatgacttccggaggaacttgatactaaatttgggactctttgctgcgggagtttggctgccaggaacttgagtgacattgacctcatggcacctcagccaggggtgtagccaagtagttctaatgtcacctgcgtcttatcatctgattgcagacaaatggaatcctgtgctgaacccgaatcttccaaaaaacaggcctacaatctgtgaccaccacaagatgtgccctgatgcagctgaagtttgattcagatgggcacttttcttccccttccctgctagtttccttttgtcccttgagtccacgcagaattccattctctgtcaagcagacaggcttaagctaaagaattgcctctattctgaaaggtctgacataagttccaagcctttcaggggtgattttgctcttggcctgagaaatacagggtgtttaaaaaacatttgaaataataccgcaacaaaggcaaaaaaaaaaaaaaaaaaaaaaaaaaaaa

SEQ ID NO: 13957 - DNA, 362 bp, Homo sapiens
tccctcattctcaacatcatgtgtgctgccctgaatcccattcgaggagttcatcttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagccttgtggaaaagggcatgtcagtgaaatctggggatggctggattcggaaacatctgcccatgtgtattgatggcagac

SEQ ID NO: 13958 - DNA, 333 bp, Homo sapiens
tctcaattgtgtggatatgactcctaatcacgcttcctaagaagcaaaggaggacaaatattcatgtgctggatagcactgtggagtggacttgaacttggattgaccttaaatgatatattcctcaaataaaagagaggcagcgacaagatacctcattatcagatgcttggtttatacattttgggactaaaatacttggtgatgaaatgacatacacctttaaacttgttatggagagaggttaatgtaaaaccaactacggaaaaccctcaacttaaggatacagctcggaaattggaactgcaattgccttttattaaaaccatatgg

SEQ ID NO: 13959 - DNA, 150 bp, Homo sapiens
ctcaattttgtggctatgactcctaatcacgcttcctaagaagcaaaggaggacaaatattcatgtgctagatagcactgtggtgtggacctgaacctggattgaccctaaattttatattcctcaaataaaagagaggcagcgacaaga

SEQ ID NO: 13960 - DNA, 577 bp, Homo sapiens
tgttttggagctcttttaggtacataaggattcctttcctgctgtacagaatgcctgcttcccttctttctctgctgctggagagagagagaagaatagacaaactctgagaacactaacagtggcttcaatttcctaccactctttccctcctatcattcttgccctgggagccatggtaactgtgccatacagcctagaggaacaaggcagaattagaaagatctttatttttgtctaggtgatatgcaagcagcctcagaccatttggcatccaacacattctttatatcagttatattactgcattgtgaatgtttaggcagctgaaaacaatgcttttggtgggctttaagaaaacatcatgctaagtcacctgcagttctagtcaattaagtttcctgaaatctttctgtattgtgtcctacattgtgaatcatatattacactgacacaaagttatgtagtgcaatttcagatctctgaataatcactagatgaaactgcagggttacttgttatgaatcacaaaaatgatttcttttcctccttaataagtgagacattgttacataat

SEQ ID NO: 13961 - DNA, 525 bp, Homo sapiens
gatttgggcttactattgataaacactctagaatacacagttttaagcattgtctatgcaggtgattggcaatggttcgatgaatttatgaggaatgctgcagaaagagtctctgaattctctgattgaactcaggcctccttgatcccacaattaaaatgttagcataagcatgatattgtcatttttgcttaaattttattctcattttttatgtaaaattatattgtcttggagataggaaggatgagcaataatcctccatttaaatgtccataaaattataaatttaatcctgcaaaaccgactaaaaagtatttcatttgcattggatttttcctaccaccattccaaggataagtattatgctcatgttgaaaaaataaaataatttagttatttattgatttcttgtcatttaattcatgttgtcctgagattggatctaaacttgagctcctaatcatcgctcagattgtgtggcctcgtaagatgtgcgtaataagtaaacaaagcatctgtcac

SEQ ID NO: 13962 - DNA, 299 bp, Homo sapiens
atttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13963 - DNA, 352 bp, Homo sapiens
gctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataataatgatgatgatgatgaaaactaaggatttttcaagagatctttctttccaaaacatttctggacagtacctgattgtatttttttttaaataaaagcacaagtacttttgaaaaaaaaaaaaaaaaaaaaa

SEQ ID NO: 13964 - DNA, 628 bp, Homo sapiens
gctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaa

SEQ ID NO: 13965 - DNA, 540 bp, Homo sapiens
gatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacacggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcgtttaattttacttcccataagcgtaaatgcctggacatagctcttgtgcaaccttaaataaa

SEQ ID NO: 13966 - DNA, 163 bp, Homo sapiens
catgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctg

SEQ ID NO: 13967 - DNA, 609 bp, Homo sapiens
atgacaaaataaatgcccaataaatgctcactggataaaggaatcaaatcctgagggtgcacaacatttcccaagcaagtggcaagaagagtccagagccgtctcgctcccgatgctggcagctctgtgtcctctcctgcttctctctatgtgttccctcgttcatactctgttctcgtctgcatcttttccgtttctccactttcaacagcttccccaccccaacccaaccccaataacaaaacactggatttaaagttaaaaggatatgatattttactgttgaatatatacaacttcccaaagaagcatagtaaaattaatcacttgcattcttttcaggttagtgtgactgagtccacccacacaagctctggggcttcagaaggcttgaataaagtgatacgttagaggtaacacatatcctgcctttactaaaaacctataacatttaattttataaaaagtcaggaaagtcagagaatcctaggtatataatcaccttttaaaaaaaatttttcattttaacttaaacataggggataatggcaagccactcataatgttgtcatttgaaggatcacaccttttaatgtagctgaatttggg

SEQ ID NO: 13968 - DNA, 367 bp, Homo sapiens
aagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataactta

SEQ ID NO: 13969 - DNA, 249 bp, Homo sapiens
gcagcagattagacacagaaagcctgatttaaaaagctgataacaccaagtgttggcaaggaagcagagaaacaagaacacttgcaccctgctgacagggctctaaactgttctagccagtttggaaaatgttggcagtatctgctgaagttgaatagtctccataagaatcaaaagctggaaacaacccaaataatcattaagacgtaaatggataaatgaattgtgatatataaggtactacaaaac

SEQ ID NO: 13970 - DNA, 412 bp, Homo sapiens
atgttcatctcaatagatgcaaaaagtgttttatttcagcaatcattcgaaacaaaactctcaccaagaaaattttctcaacccaataaatgctacccacaaaacaaaacaataagaaaagccaaacaccaaagcagactgtaacaaatatcatatttgatggtgaaatgctataaataaaggaagtaaaaggttaaaaattagaaaggaagaagtaaagcaatcattatgtatgtatgtagatatgattatctacagagaaaatgcaatagaatttgcagataaattatacaaattggtagaaaaatatagcagaattcacatatgaaagtcaactgcatttctgttagataccaactgagtatctaacagatactcatttatttaaaaatattatttatagtagaaacca

SEQ ID NO: 13971 - DNA, 517 bp, Homo sapiens
agataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacattttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatc

SEQ ID NO: 13972 - DNA, 509 bp, Homo sapiens
ggtttgagggaaaggtctctgggcaagcaagtggttatttggattgcttgcttcccttttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttggggtcagtgctctctattgatgttcttgctggtctccagacacattcctgttgcattaagacttgaaagacttgtagatgtgtgatgttcaggcacaggatgctgaaagctatgttactattcttagtttgtaaat

SEQ ID NO: 13973 - DNA, 425 bp, Homo sapiens
aatataattcagtttctcaataacaaagcacctgcaatgtctagcatagaattattatgcttgttaaaaagcaggaaaatgtgactcttaaccagaatgaaaaagttgatagaaataaatatctaaaatgaaaaatccaccagggagtggtggctcacgcctgtaatctcagcactttgggaggctgaggtaggtggatcatttgagggcaggagttcaagaccagcctgaccaaaatggtgaaaccctgtctctactaaaaatacaaaaaaattagctgggcgtggtggcaggcacctgtaatcccagctactcaggaagctgaggcagcagaattgcttgaacctaggaggtggaggttgcagtgagccaagattgtgcctctgcactgcagcctgggtgacagtgtgagactcaatctcaaa

SEQ ID NO: 13974 - DNA, 491 bp, Homo sapiens
gggggaacagattacaccccctctggaaatggagaaaaatctaaagaaaatattgctttaaaagaaagaatctcagggagttatatctgccaataagggacaaccctggttagggttttctcaatgatagttaaattacatcaaattagggtttagggacatgatttctccaagatgccaaaaaaaaagagaactgtatagcagctctaggatttatctagctacacgtttaaacttccatttccaagttatatgcaagattttgtaactgaaagctcacagaaagtaggatttaaaagggctgaaaatttttccctcttcctttttctccctttggaaaaatgtcatgtgatgatgtatttgtacctatccaaagaaagcatacattaaaggaaagaacttccttcatataatgatgtgtggaaaggaaaatgggacacagtgggctgaaaaagagccattattgtaggggtctactcagactttgttgg

SEQ ID NO: 13975 - DNA, 364 bp, Homo sapiens
atcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtactaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtta

SEQ ID NO: 13976 - DNA, 397 bp, Homo sapiens
gatcccgtacgagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaa

SEQ ID NO: 13977 - DNA, 189 bp, Homo sapiens
atgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcaaaaaatctgtaactcgcattttaatgatc

SEQ ID NO: 13978 - DNA, 205 bp, Homo sapiens
tattttatggttatgtttttctgtgtgtcagttttcatagtacccatattttattactgtttattacttccatgaattttaaaatctgagggaaatgttttgtaaacatttattttttttaaagaaaagatgaaaggcaggcctatttcatcacaagaacacacacatatacacgagtagacatcaaactcaatgctttaattgt

SEQ ID NO: 13979 - DNA, 388 bp, Homo sapiens
ccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcaa

SEQ ID NO: 13980 - DNA, 538 bp, Homo sapiens
gtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcacaaaccctctgaggttttactttaagggtcgctgtatgtttgccttgggacaaaaaggctacctacacgtgctatccagtaatatacttaaataagccatacttagatctactgt

SEQ ID NO: 13981 - DNA, 520 bp, Homo sapiens
tgaagcccacaattgacctttgactaacaggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaaa

SEQ ID NO: 13982 - DNA, 593 bp, Homo sapiens
tgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgagccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttgggctaagttgggattgagtttcaacagcatctctgctgttgacaatggctctctgggcaacacgcctcatctgagggagcttcacttggacaacaacaagcttacagagtacct

SEQ ID NO: 13983 - DNA, 507 bp, Homo sapiens
aatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttaatcctcctctccctcccattgcatggctcacacctgtaaaagaaaaaagaatcaaattgaatatatcttttaagaatcc

SEQ ID NO: 13984 - DNA, 471 bp, Homo sapiens
agaacgagggccagagcagaaaaatgaaaataagtggagacacttatggatacattggtgcaaaaaaagccacggagcccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaaggggacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgcgaaaaaaaaaaaaaaaaaaaaaaaaaaa

SEQ ID NO: 13985 - DNA, 348 bp, Homo sapiens
tgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaggcc

SEQ ID NO: 13986 - DNA, 243 bp, Homo sapiens
ggggagatggggttccaccatgttggccaggctggtctcgaactcctgacctcaagtgatccacctgccttggcctcccaaagtgttgggattacagacatgggccaccatgcatggccgaaggtaaactttctaacagaaggctccccaacctgaaaaaaagggacacaaggaaacttttggaggcgatgaatatgtttattaccaggattatggtaatggtaacacatatgtccaaactca

SEQ ID NO: 13987 - DNA, 287 bp, Homo sapiens
tgtgataaatgaaccaaaatttcggtcccttaaaatggtatccacaatttagctgatgtttcctaagacatgatatagcgaccagaagtttgattttgagtattccagaaggagaagaaatgagtaagagcatggaaaaaatttttaaacaaaatagtagctaaaaaaatttgtcaaatctagcaagagactgggacacccaaatacaggacctcaaacatattcaaattgacacaaccccaaaaggccttctccaaggcacataagagtcaaaatgtcaagatcaa

SEQ ID NO: 13988 - DNA, 546 bp, Homo sapiens
gcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctgggacctattccctatgaattcatggcataatagtgttaaaaaaaaaaataaa

SEQ ID NO: 13989 - DNA, 351 bp, Homo sapiens
gatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatggtaaaaaaaaaaaaaaaaaaaaaaaaaaa

SEQ ID NO: 13990 - DNA, 546 bp, Homo sapiens
gaaaaaaaaactgttgctaaaagtcccccaacttgcagtactttgttacggcagcccgaggaaatgaatacggaggatattgttgttatttaggtgagaaatagagttggcccagactagtgtgatagaagtcaaggtgaagaaaaaaggtcagaatctagaattattttgaaagtagagctataagatttaccaaaggattgaatgtaggttttgagggaataataaaggaaccaagaataatccaagacttttaatctaaactattggaaagatgttgccataaactgaatgaggaaggctttgggtggagcagcactcaggggaaatacaaagagtccagttgttaacttttagaagcctatttaatacccaagtggagatgtcaggtaggcagttgtacataaaagtcttgaattctggagagaggctcagctaaagatataaatttctgagtggtccacataacagaggcattttcagccattagatggcacaaggttgaaagagatcactaaggaatgcagagcagagacgaaagcaagg

SEQ ID NO: 13991 - DNA, 517 bp, Homo sapiens
aatttggaatagtgctgctgccagcttatttttctggtacttgtattttcacatgttaaatgatctttatatatgttgaattaacaaatattttgagtttctgagaaaaaacaaaacatattaatggtattgaaatgtgttagtagtctggctgtgtgcccaaaattctgtttcgcagcaaaagtgaagacctgtatgtaaagaaagtataacaattatttctttgtattttaggggctttaaccggaacatcgtctagctggtgttaggaatgtttgcttaatttccagacttttttttaaaaacacatcgtgggttttttgaggccccaacctgattagtgcatggtcagccctcaatgaaggctgaggcgtctctgactgaggtgtttttgtttggttttgttttttaaaatcatgtatttgctacaaagtattgtacttgtctcaatgggaatggtgtaaaaaacaaaaggccttatgtgatctgtatcatagttaataaatgaatcttgcaa

SEQ ID NO: 13992 - DNA, 146 bp, Homo sapiens
tgtgcagtgcaggttttgccatactcatttcaagtattatagacatatgtaatggtgaaaatatatgaactgtggcctttttcattcttgttacttgtgatgcaattaagtgaagataagaaaaaaaaaaaagcagagatttacca

SEQ ID NO: 13993 - DNA, 163 bp, Homo sapiens
gactgcagcgagatggttgaacgccgcatgcacagaactccaccggctgaatggtctgtgggctgggatttgcattcaagttccatttcctcacaggaacgggtgaactgagtttcataatccaaggcgaccttctcaaggaagctattgcctttgttaacat

SEQ ID NO: 13994 - DNA, 535 bp, Homo sapiens
aagtgaatttgcctgtaacaagccagattttttaaaatttatattgtaaatattgtgtgtgtgtgtgtgtgtgtatatatatatatgtacagttatctaagttaatttaaagttgtgtgtgcctttttatttttgtttttaacgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtaccctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtgtgcacctttcagttgaaaataaagtgtatattttttcaaa

SEQ ID NO: 13995 - DNA, 535 bp, Homo sapiens
attttgttgcaatttatagaactttacccatacctgtaagaccctcaatgtatatgaaatcattttcactgggaaagtgacagttacagtaaaagcagaaccacacaaatctttatttaaaagccgaaatatcagccttctctctctcttttgctatttgaaaggtagtcttcaatttggcaggcaactgcttctctctccaaatagtaacaggttacaaacatgctactttaaatatgaataggacctaaggctttagtattttaaatcttgcccaatacagaaatgtctttcaagagactttagtgatgcttaatttatgaacaacaaggaattattttccttttgattattcactttttcaaaactcatagatcagaataaacaaaaaatcccccaacccatggtggggacacaaaagtaacataagtgactaaggtgtgccattcatagagaggttgaagactcatgccccaggaccacttagctgcatagggtgaaatagtctactttttgatttcatgaatttttttcc

SEQ ID NO: 13996 - DNA, 592 bp, Homo sapiens
aaggattcagtactttctttgcttgtgggtttcctcttgttcacttttgatctagatattggttatgttccagtcctcctgcatatgcccaagaggattgggagtggaatggacaccagcagaagcaccacagttattcctgtagagattagaaacaaggagcttattgccctgcttgtcaaggctcaggacagacaggaggaagaaacaagtataaaggttttggttttggaaagaagttggaatctccagaccctgggaccttaagatccacaaaattgctgaaagaaaaagtactaccttattgaaaggtaagatattaaactgttttaaggtttaagctatgttagccacagtagcatattttcataaactatgaattcaagcagtcacttctgccaaactgaagtttttatgacatcgccacccatccagccttgctggtgagatggagacctatgtagtggagagatgcatattgcaaggaaaaaccttcacaaaagttcactcgtttttgaaataatgtttactgaatgccaggcactgtactaggccttggagttaccctacctactttccagaacctttcatc

SEQ ID NO: 13997 - DNA, 375 bp, Homo sapiens
ataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctg

SEQ ID NO: 13998 - DNA, 345 bp, Homo sapiens
gttaaaaccgaagaacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaagtgaagaatattttagtagctaggattttatctgatgtagttgcttaaagatctgatgtgctataattccagtgaatcagaaataataaaatgctatcattctggatctgaagacttttg

SEQ ID NO: 13999 - DNA, 389 bp, Homo sapiens
aaagagtgttttactccaacgattgaaacattttcctatttaaattccattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaatagtcctgcctgaggttgcagtgagccgagcttgcactactgcactccagcctgggtgacagagtaagactccatggcaaaaaaaaaaaaaaaaaaaaaaaaaa

SEQ ID NO: 14000 - DNA, 306 bp, Homo sapiens
aaaagttccaaagtttgttttttaaaaacattattcgaggcttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctc

SEQ ID NO: 14001 - DNA, 735 bp, Homo sapiens
actatgcgttctcccctacagaatgctcttgccatatactttgtgagatgacatgattcagaattatctccttggcttctcatagagagttccaaatcacgtcaccttgctttgtggagaaaatgaccagttatggatagcaagtacatttgaagctgcttccgttgcttggggatctatctaacagtatgaggctcaggagaagttttgccctttctccctaggaggacgtgctttctacaaacagccaatgttctgagctgcttcttaaagatgtgatttcaggagctcactgcagacttcctatgcaactagcccaagagttctttgggctctaagaacttatcaaagaactcagcagtatgagaatagatcaatacatagagggttcctttaagtcttgtagaaactcattactctccagtctctttttccacttatagtagagaggaatcagacttgcggatatccagttaactatcaatacctttaaaaaatgtgaccaagcagtccatctgaataattataccaaatggtcaaggcttttaaaaagtgcttaaactttaaaagggccctttgcaggtggttcaagacctaggattcctcaagttcaagtttaggcccaggaggaggaggaccaggggaaaaaaaatggagggaacaccttttttttaacgcataaaaaatttccactgggtttttggaaaaaacctaattggattcccttgggataaa

SEQ ID NO: 14002 - DNA, 550 bp, Homo sapiens
ctctgcttggaggaggatctgtttattgcttgtctctcccttcaaccccaatcctttaaaggcaggggtttctgtcttattattatatcaccagcacccagaacactgcctgtcacataaaagatgctccatgcatacatactgattcatttactgacaccccagatctccaaaatacactattagttcccttgtggcagatggaattttactctgttggccattctatgtgtcagactcaattagacctaatgaattactttactacctacatatatattctattctgaattaagtttatgtctgtagagactgatgtttacatattctttttgctcctgcattcctttaaaaaatcactgatttctcttaagtctacagaggccttgtagaagttatactgctttatactgtgctgatatataaaatgtttcatactcttctaatgtctttagaaatctaaacaatgctattgtacttgaagaccatattacaattagaaatggtggaaaagtggtacaatattagtactgggaatatgatagcctta

SEQ ID NO: 14003 - DNA, 676 bp, Homo sapiens
ggctaactctttattaaacagatcgcatattatgatcttgctgcagccacagagcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttggctgaaatacattatattgacgtttgagataattctagtccaaagtataataaaactggatgtataataaaccctttaaatcattggaaagggacaagtgggggaactgaagcatttactggcaaagaaatgttactctaatggttacttgctcgggcgtggcacactggttataattggctcatttccttgctattggatacatagggggcatttctctgtcactggaactattggaaatgacaaatttcatcttactgcccaatcaaaatgacattggatggggaatgaactccagaggctgggccctgaaacagggggagggtgggccgctccaggccctgggggcctcaagtccgtaacgaacaggaaccttttaaaactttttggcccctaatctgttaaaaaaatattgcctatggccaattaaaaagcctttttaaaatcc

SEQ ID NO: 14004 - DNA, 142 bp, Homo sapiens
tccttcctttgtgaatcactgtgtgccaactgactattcattgtgttggagtcacagccatggggctttctgctgctcacttgatttcagatatggccagtggaaactcctgctggctggttcctgtgtccttttcatatgt

SEQ ID NO: 14005 - DNA, 230 bp, Homo sapiens
ttcttgatattggcctgggaaatgatttttttttgatgtgacacaaaaagcacaggcaacagaagcaaaaatagacaaatgagactgcatcaaactaaaaagcttctgcacagcaaaggaaacaacagagaaaaaaggcagctaaggaatgggagaaaatattttcaaactatgtatctgataagaggttaacatttaaaatatataaggaactcatacaactgattaac

SEQ ID NO: 14006 - DNA, 203 bp, Homo sapiens
gacagcagaggcagttatctctgaagaacctcaaggtagatggaggacaccaaagctttctcaggatcagtgcctctccttactgccatcccagcatctgctatgcacttggtagctatagcagggtgtgactgggaactagccctgagagtgggccctgatcctactaccagaatggctgatttcttacaagtcaactccag

SEQ ID NO: 14007 - DNA, 244 bp, Homo sapiens
agcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttaaaaaaaaaaaaaaaaaaaaaaaaaaaaaaaaaaaaaaaaaaaaaaaaaaaaaaaaaaa

SEQ ID NO: 14008 - DNA, 610 bp, Homo sapiens
gcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatgggtactgctcgtctgttctgtgttgggtttactaaaaaacgcaacaatcagatacgggagactctatgctcagcacaacaggtccgccaaatccggaagaagatgatgggaatcatgacccgagagtgcagacaaatgacttgaaagaagtggtcaataaattgattccagacagcatggaaaagacata

SEQ ID NO: 14009 - DNA, 393 bp, Homo sapiens
ggtgtccctaaggtactctgatatttttgtgtgtagctaattcgtcaaaaaataatgaaaacaataacttaaatatgtgtagcaatttatggtttcaagtaccatcatatttagttggtttgatcctcacaccgtcaatattacagaagttcatgcaaggtgagtaattggccttaggcaaaaacaactaattaatattaaagacagaattgaaagataccttgttatttctctctcagttaagtcttttaaccatcaagtaaggagagaagaggaaaatcaaaactaaaatgatagagtatctaaaagttaatggaagggaaaacttcttattaaaactgtgctcctcaatgatttttagtatttaataaaaaaaaaaaaaaaaaaaaaaaa

SEQ ID NO: 14010 - DNA, 332 bp, Homo sapiens
aagattgaggaggccaactgatgtcaagcccaaatatgagaagaatcacaggatggtagtaaagacggaacactgaagagaagatacataattaactgccttttggacctactgagtgtgaggtcatagtaaaatataaaaccagcaataattgacactgttggagatatgattggaggtgtttaagggaattaattagagaaaaagccttcgtgatcaaaaaaggatggtgattattgaaatcaagtgaaagggtagcttttccagggagagaaaataaagagctgaggaaaacagagtttctgagaaggatgggtgtgctgcagagacgg

SEQ ID NO: 14011 - DNA, 341 bp, Homo sapiens
gtggcagagtggggaagtgtacacagggtttctaactccaaattttgtgctgtgtcctccagaacacagacctcctaccacattggttgctcctcaggttcaggaatgtttcttcaaggtaagaaacgtatcctcagggtcagaaacatgttatcaaggtcagtttatgtgttttttttttattctctacactctgagcatgtgacatagagccttatcctgagtgaggaatggtgaagaataaaatgcactgatcactcatgagtgaagggagaagagaagaggtagattggtggaaggtactgaggtaggtagacttcttgaagaaaggcagaaaggca

SEQ ID NO: 14012 - DNA, 618 bp, Homo sapiens
tgacttattttgtagcaggaaatttagactgttaataaactaaaacacataaagaaagctgtctagacctttcagtttatattattagctattccattgttttttcttcaagagatcaaaagtttttatttcagttacctatttcagacaattataggataaattgtatattttgttccctaaaacttatgtttataataaaacaatttttatatctaagtacctttatgtattgtttcttcatttactttataatttagaataggtacaaaataatggaagttgttggagtattcattttcaactatatagggtgagtatacagaaaatggttggagctgggtgcggtggttcacacctgtaatcccagcactttgggagtcaaggcaggcggatcacctgaggtcaggatttgagatcagtctgaccaacatggtgaaacgccatctctactgaaaatacaaaaattagctgggcatggtggggtgtgcctgtaatcccacctactctggagactgaggcacgagaattgcttgaacccaggaggtggaggttgcagtgagctgagatcacgcactgcattccagatgggtgacagagcaagattcatctcaaaaa

SEQ ID NO: 14013 - DNA, 614 bp, Homo sapiens
tgactgtgtctgagtccttgaaagaataatgtgccgagatgtaacattacttttactctgtatgatatattctgggtatcaacataatttggcctttactagttcagaagagaaatgaattcggtcatatctaatgtgcactgataactgctctcaaattaggaactcatttgacaagttctttgaatcttttgccaaaatttaaggagtttgttgatctttgtagtctcccagaacatgttagcttttttttccctgtaaaagtaactaagttgtatcattgatgacatgccatgaagattttcaagaatctatcctgttttaaataataatgagtttcagaaaaattgattttgctttgtgcacaaactataaaaagccttattcattaaacagattagttcttcctctgcaggctacactaaatgttgggtataaaaatgtataatgcctagaaagtgcattttagatgattattttaatataatctcgtgtgattaatttgcaggctgactatgtaggctgatacatccgatctggagatatacaaagtttaaaacttttagggagcatatttagaaagtttcagttaaatctttaaaacatatatcttt

SEQ ID NO: 14014 - DNA, 474 bp, Homo sapiens
tatttcactaattatgaggatcacattcttttagtcctccaatcattggatatgacaatttatgctttaactttcatttagtcactttttaaaagaacaaatgacctgaattctgacaccattaaaggatgcactctcgagacattatttattacttctgtgattgtttttaaacaatttgagtcgtttctttgtcaaggtgtaacaaagtaaagctgtgtaatacattacaaattaatagacagtttcacctggagatttgctatattttttgatgtgtgactatacatacacagatgtgtacacacacatatatatatacaaacatacagacagtatgtattttcataaacagaacaatgttcattcagagcatcagctagactatttcattcctgtacttataaatatatcctacagtgtagttttatttaaaattattattataataaacatttgtgaaagttccatatt

SEQ ID NO: 14015 - DNA, 419 bp, Homo sapiens
aaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgcctcacctggacttaagcgtctggctctaattcacagtgctcttttctcctcattgtatccaggttccctcccagaggagccaccagttctcatgggtggcactcagtctctcttctctcagctgactaaactttttttctgtaccagttaatttttcaactactaatagaataaaggcagttttctaaacttcctgt

SEQ ID NO: 14016 - DNA, 476 bp, Homo sapiens
gcttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaaaaa

SEQ ID NO: 14017 - DNA, 246 bp, Homo sapiens
agtttgagatcagtctgggcaacagggtgaaaccccgcctccactaaaaatacaaaaaaaagaaaaaaaaaagaaaaaaatagctggccattgtgacatatgcctgtgaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaa

SEQ ID NO: 14018 - DNA, 333 bp, Homo sapiens
gttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccagaaacaaccgcgtaaaaaaaaaaaaaaaaaaa

SEQ ID NO: 14019 - DNA, 623 bp, Homo sapiens
gatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctgggagaacaccattcctgatttcccacaaactgcactacatcagtataactgcatttctagtttctatatagtgcaatagagcatagattctataaattctacttgtctaagacaagtaaatctgtgttaaacaagtagtagta

SEQ ID NO: 14020 - DNA, 574 bp, Homo sapiens
attgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggagacaacacccaagatgaattatttttgagactgtcaggaagtaaaataaataggagcttaagaaagaacattttgcctgattgagaagcacaactgaaaccagtagccgctggggtgttaatggtagcattctctttggcatacatttgatttgttcatgaatatattaatcagcattagagaaatgaattataactagacatctgctgttatcacatag

SEQ ID NO: 14021 - DNA, 524 bp, Homo sapiens
gaattttaaaatctgagggaaatgttttgtaaacatttattttttttaaagaaaagatgaaaggcaggcctatttcatcacaagaacacacacatatacacgaatagacatcaaactcaatgctttatttgtaaacttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggt

SEQ ID NO: 14022 - DNA, 154 bp, Homo sapiens
gcatatatgacaaaaccgactaactgtattagattacagacctacttgaactacatgtaaacttaagtattggaatcacctcccttttccccacttctgtggtaatttatctgtaggttgtttgattctgtaataaccaagaaaaaaaaaaaaa

SEQ ID NO: 14023 - DNA, 600 bp, Homo sapiens
ttgcggacgcctgcttaaagattgctggaggatagtttcaagtggaccgagccggcacgacatagcaggggggcgcctctgagacatgacagaaacgggagcaccggtaggctgctgacaccatggacaaggggagcagttgtgagctgagatgctggaaacctagcggatcaactctcttagttcagggagcacattgcagcctgctgaaaatgagtcaggtttccggacgtgttggctcacacttgtaatcccagcactttgagaggctgaggcgggtggattgcctgaggtcaagagttgtagaccagcctgccgacatgggtaaactcgtctctactaaaatttcaaaacaaatagtcagtcgtgtttgcaggacctgttatcccagcttctcaggaggatgagcaggagaccgcttgaacccaggaggtagtaggttgcagtgagagtagatcgcgccatttgcactccatccttgtgcaaaatggagcgaggattttgtctcgaaggaaaaaaaaagtaaaaacgtttgggtttgggaatgaagaagggggaaaggtctagagggccttgacttgggggaatgggaaaaggtga

SEQ ID NO: 14024 - DNA, 500 bp, Homo sapiens
taatcaaaagctggtcgagcttaaactatgaaataggcctggagcacgtggctgcacctgttatcccagcactttgggagactgagactctcaatgcacctggggtcaagcgttcaagactgagaaaacatcttaaatggccatcctcaaggcatgataaatctaagtactggcagccagcttgtggatgtaacaaatggcacagctcatgcacctaaaaggacacaataagtgaacaccatgtagaggaggcatgatccaatcaacctagagatgaattaaataatttcccagggttgccttgactattgataggattcattgggttaagcttcgtgatttaagtattgcgccctccggaagagtccccaataaatgcctcttcatctccccggttgggacctgtagaagctttatgaagaaagttgttagaaaaaatgacggccgggatcctagaagaacaggtgaaggaccttcacctggaaatttggggataagcc

SEQ ID NO: 14025 - DNA, 520 bp, Homo sapiens
taagctatagacatgaaacaagtcatgctgcacaaaacgcaaacaccgagactaggagagaaaaaatgatctacaccactaagcaaatatgctcagtgaagcactcttattgagggggctaaagccgaataaactgttgcatatagcagcccctgggatgcgagaaaatactgattcaaatccaagaggagagaaagagtaccaggttccttgaaggctgaaaaagagaatccacaaaatgttaaatctatatggcgcccagaagaaggataaatcactataaacactcagagatccctcaacaaacatagtacatagacgggccatggaaagtaaaacacctggggctatggctagggaaacgatagttttaacgcccgaaggcgggccgcctcccaaattccctggggaaacaaagaaaagaaaatggtaaaccacccgaacccccaaaaaatccctggggggaaaagggacccccaggggaaaaaaaattgttttaaaggaaaaggaaaagggaaaa

SEQ ID NO: 14026 - DNA, 351 bp, Homo sapiens
attcaacattttctcaatgaagtagaaaaagaataaattcaaaatggtcgggacccccagacgtgctaggggcaataaagcattgggtgtaaatgttcttctggcattctttctaagcaggcagcaagtttttattaaatgctttaaggaaaacaataatagagtaattttggagccgccaattacatcaattaagaaatttcagaaactgttaaaattgaggctaagcagctttaaaagtaaaaattccagatttttactgggggctttttaaaaaaaaaacaactttaacacttgaacagcctggattttgccccatgtcggtaaacctgcgtttctgaggaaaaaaaa

SEQ ID NO: 14027 - DNA, 729 bp, Homo sapiens
gcctttcacatagtaatcaaaagttggttgatgtaaaagtgtgaaataggcctggagctgtggctcacacctgtaatcccagcactttgggagactgaggctggcaggtcacctgaggtcaggagttcaagactgggaaaacattttaaatggtccattttcaaggcatgataaatctaagtactggcagccagcttgtggatgtaacaaatggcacagctcatgcacctaaaaggtcacaataagtgaacagaatgtagaggaggggtcagcccataaaagggaagaaagttttgttattgggaaattgaaacttaaccagggaagggggccagggtataaccttataagtggaataatgaaacttaggcgacgtccaggaagattgtaaccccatagtactcgaccaatgaggaactgggagaagaacttgtgtgctgggagataaattatctgctgtaactgccctgggtgtgcctgcctaccagacacccatctgcaagactgctattagaaggctcactttcactgggtctctgagtccattcttttgaatttggacgggtaaatgtgtgttttttcagaaagaaccagcctggcccaacatggtgaaaaccccttctcttcctaaaaaataccaaaaatttgcttgggccatggggggcacaacacccttttgggccccagcttccttagggagggctggagggcggaaataattcggtggga

SEQ ID NO: 14028 - DNA, 505 bp, Homo sapiens
actctgatagaaaactcagtctttctggactgaagaaccagaggacagagttcaggagtttcagtggttacagcgctgaaaataagggagaatcctagaacgaagagaaactcagccccaaattctgtatatgaactgcctcggtctccagctgaccctgaaccatgcttggcagactccaggtagctcagctgaagataattatgaactaaactgggctggatgcagtggctcatgcctgtaatcccaggactttgggaggccaaggtgggtggatggcttgagcccagaagtttgagaccagcctggcaacatgtcaaaaccttttttctacaaaaaaatacaaaaattagctggtccgtggtgacctgcgctggtactcccagctacttaggagactgaggtgggagggtagcttgagaccaggacagggaggttacaagtgaagccaatattgtgccactgtattctagcctgggcaacagagggaggcccttgtctccaa

SEQ ID NO: 14029 - DNA, 690 bp, Homo sapiens
gccaccatgagggtgtcagctcaagagctcagaggaaggaatcagactgtattgacgacccatctctccagacaggttcttttataatactcaccggactgtaccgttcttatagtcatatcaatacagtccctttcttacagctcacagagatgttatggaactatagtggataagtgattaagaggattttctggattttgacgggaaagttcctatagagatgaaatattttattttattttattttttgtctttctagacagagtttctctgtgtagccctggctgtcctggaactcactctgtagaccaggctggcctctaactcagaaatctgcctgcctctgcctcccaagtgctgggattaaaggtgtgctccaccactgcccggctgaaatattttaatttttatacccctgttctcactttttaaaaatgccatggaaattgaggttaaacactaaaacagttgaatagcacctgacctttatatacatactataattccattggagtctttcatgaaaatccttagagatagatgaagcaatattgcagtggtaagaagtctaaatgactctggcatacagaaactccgcttttgtgacatgagaatggggtaataatttacctattagacatcggggaacccatagaaaaaaatgccggctttacaggggttacccca

SEQ ID NO: 14030 - DNA, 444 bp, Homo sapiens
agacatacacattcaaccagaatatataataacatgatatgatgagataccaaagaaattaaagtggcttgaattggggaaatatttctttcaacagattggatacatgaactcaaagggagtgtgctgggggcctttttctgagttacggtctctatgctcccttggccaccttgctctgatggtagcagtgtcccgaagaggtcgccatgcttccaaaaatctgtaacctatactgggagatggaaacctgtgaaatgatgtttgccagttttctttaccgatagatgttgaaaagcaatgtagtagtactgactctagacttcagttataaaagaattattttatctatagtctttgtttaaaacttgtttctgttgcttcatagattttctcttttccctttttatggagaatgctctgcagattattccccccgccaaa

SEQ ID NO: 14031 - DNA, 199 bp, Homo sapiens
aggccacaatagcagtgaagactgacaaatcagatattcccaatgactgacagcttcccatcttgcctctacctcaggtaagtaatggcaccctgaaacctagcttttctgacttccatttctgacacccgaaaatgaaaatgataatcccaacctaacaccaagacctgtagcaagaacgaatttggacagaaaatgg

SEQ ID NO: 14032 - DNA, 347 bp, Homo sapiens
atcgtactacacgacacgtactacgttgaagctcactttcactatgtcctatcaataggagctgaatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaatatcctatcatctgtaggctcattcatttctctaacagcagtaatattaataattttcatgatttgagaagccttcgcttcgaagcg

SEQ ID NO: 14033 - DNA, 223 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 14034 - DNA, 520 bp, Homo sapiens
gccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactggtgtatgatgttttgagatac

SEQ ID NO: 14035 - DNA, 432 bp, Homo sapiens
acagcacggttcgtttttcctttagtcaggaaggacgttggtgttgaggttagcatacgtatcaaggacagtaactaccatggttcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattt

SEQ ID NO: 14036 - DNA, 421 bp, Homo sapiens
gaaatccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatatacttgtttttccattgtatgcaaattgaaagaaaaagatgtaccatttctctgttgtatgttggattatgtaggaaatgtttgtgtacaactcc

SEQ ID NO: 14037 - DNA, 510 bp, Homo sapiens
cagaatcattcagccattcagacactttgtgacaacctaaaaagagaggagggagtgagatttttgtatgaagtaagaattcacttgtttgtacatgaacagcatatgctagcctgctttgaagactgaagttcttggctttccagtttataaaccagttctatctgggcagcttgcagccaaattgtgttgtggaggaatgggactcaggaagcacgggcaccctgaaataggtggatgtggtctgtggaaaaggtggaagcacacactagggttctacccttaagaaaatgaacctttgctgagttatcaaagtgagtacttgctatttctcaggatagccatgccacaaacacatatttacagtaaaattcaagttggtaacaattaaaatgactgacctctagtttatctatatattattggaacaaaagggcttactgagcaatgccaaggaaagaaacttcaagtgggttcttcttactctacataaaagaataaactatttta

SEQ ID NO: 14038 - DNA, 461 bp, Homo sapiens
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccca

SEQ ID NO: 14039 - DNA, 542 bp, Homo sapiens
atagtaaaaaataattcagatagccagagtgtctatagagtgcaaagtatgtctttttcccacaccagcctcctattcccccacacagaagcaaccattgtatctaaattgtggttattcttccaaatatggtgttaacatgaatttatttttatttttattttgcccaggctggagtgcagtggcacaatcatagttcactgcagtgccaaactcttgagctcaagcaatcttcctgcctcagcttccgtagtagttgggactagcaagcatgtgtcaccaggcccagctattatttttattattttatagacctggtgtctccgtatgttgcccaagctggacttgaactcctagtgtcaagcagttctcctgccttggctcccaaagcactgagattacaggcatgagccaatgtgcctggccattagttgttttttttttaaaaaatgacatttgagcatcaattcttaagaaaactagaagagccagatcttgtaccagattgacatctgaatgggccaagctagagaaggctggag

SEQ ID NO: 14040 - DNA, 685 bp, Homo sapiens
agactcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggttccaggactgcgtgtctgctcctgagctctgttttaagtatgtgtatcctttgctgtattttgtattaaaaaaaataagaaaaagaagcctttatgttgagcatgttggcatggcccccttaattttttctcttttgggacatatgaagcaagttatccttttccggaacctttttcctttggaaacctttttttggtttggtt

SEQ ID NO: 14041 - DNA, 439 bp, Homo sapiens
ggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagagatatttcttactagtgctttaagctccagagtaaacagtcatttaaaatggagttcactgggcaggtttcccctttaatctagatagaaatactctttatcagagatttaaggcactgttttgctaactggtaaataaaaccaaatgt

SEQ ID NO: 14042 - DNA, 331 bp, Homo sapiens
gtctggcaagaactcgaacccccggcaagcacgcaactaaatcccgaaatacaaaaagtaacacagtggacttcctattaagacttacttgcattgctggactagtaaaggaaaattgcactattgcacatcatattccattgtttactaaaaaaatcatgtgataactgattattacttctgtttcctcttttgggttctgcttctctcttctctcaacccctttgtaatggtttgggggcagactcctaagtatattgtgagttttctatttcactaatcatgagaaaaactgttcttttgcaataataataaattaaacatgctgtta

SEQ ID NO: 14043 - DNA, 612 bp, Homo sapiens
aaccgaaacgtgccggagattgctgtgtaccctgcctttgaagcacctcctcagtacgttttgccaacctatgaaatggacgtgaaaatgcctgaaaaagaaccaccacctccgtacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgctacttgctaccctgagtactttcaggaagactgacttaaatattcggggtgagtaagtagttgggtataagatctgaacttttcatctgcagaggcaagaaaaatatttgacattgtgacttgactgtggaagatgatgg

SEQ ID NO: 14044 - DNA, 556 bp, Homo sapiens
gttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaactactttatttaaaaggttttttctttaatttaaatgaaatggggttgaagtgaacatgattttgttgaccatgttcgtgaattacagatgcaacatgcattgggtagaatcgtgtgatgggtcttt

SEQ ID NO: 14045 - DNA, 546 bp, Homo sapiens
aaaacagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtgggctgttttacccacatgacttattatgcataaagccaaatttccagtttaagtaattg

SEQ ID NO: 14046 - DNA, 432 bp, Homo sapiens
caccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaagtg

SEQ ID NO: 14047 - DNA, 510 bp, Homo sapiens
gaatatatcttttaagaattcaaaactagtgtattcacttaccctaggtcattataaaaaatatctaggtatggtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaaggttacagattggtaaatatcacctgctcaacatgtaattatttaataaaactttggacattaaaaaaataaattggggcttaaggagaaa

SEQ ID NO: 14048 - DNA, 525 bp, Homo sapiens
tccacaaatcagtagaaatgaaacaccacactcttaaagtcaaaggaaatgtaacaagccaacttagaagaattcccagagacaaatgatactacaacacaacctaccaaacttctggggtgcagggaaagaagtcgtaagagggaagttacacacatagttaaaaaaaaagatctcaaatctacgctatacctcaaagaactagaaaaaaaaagttacacccaaagctagaagaaaggaaattctaaaaagatgacagcctgggcaacacggtaaaattttttgtattctgtacaaaaaataaaaaaattagcctggcatggtggcaaatgcctgtagtcccagctacttgggaggctaaggcaggaggatcatttgagtctgggatatagaggctgcagtgagccgagatcacacgactgccctccagcctgcgtgggaggatcactcaagcccaggatgtcgaggctccagggagccaagccatgatcagaccactgcattccagcctgggtgacagggcga

SEQ ID NO: 14049 - DNA, 327 bp, Homo sapiens
caaaaataattggcttcaaatttctaagattctgtgggaggctgagggaggaattactatatttttttatttgcaaaccagcaagtagatgatttgtgtactggaagggggaaaaaaaaacagtgatgtttttctccccttatggcatatagttaccagcctaggtttctatttttactctaccctagtccctgggcatgattttcccttatttagaaaacttgcaactacaaatgtattgaattcattttcttacctttctgctaaatatagagaacaaacctatatttcatgcctagggattattttaagcagaattgagaccaa

SEQ ID NO: 14050 - DNA, 461 bp, Homo sapiens
aggaactgagcttgtggagaccagaccagcaggagatagaaccttccagaagtgggcagctgtggcggagccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaagcctgagacagctgtcttgtgagggactgagatgcaggatttcttcactcctcccctttgtgacttcaagagcctctggcatctctttctgcaaaggcacctgaatgtgtctgtgtcc

SEQ ID NO: 14051 - DNA, 293 bp, Homo sapiens
agcatgaccttgttactgtgatacttgaaatatccacagtactcactttttccaaatgatcctaggaatggcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaaaaaaaaaaa

SEQ ID NO: 14052 - DNA, 272 bp, Homo sapiens
cttgagattcagactcagatttagactagaaaatttctaaatttgtccgttccatcaactcacagagggttgtttctccagtgtatttagatacaggagtggagaaaaaagccaaacaatatatctctaattaggctttcataatgtcacatcgattgtcacaaatgcctcattttggggataagatatggtaaatgctgaacctgggtcatctatatggctaccccaaacaagtgaggtattgatcacagcaaaaaaaaaaaaaaaaaaaa

SEQ ID NO: 14053 - DNA, 483 bp, Homo sapiens
tgagtggttccacggtatgttctgatgggattcccgatggtttttgctgaaaataatgtgaagggtgaaggataaggaggaatctgggatgttcttaggtttttacaaagctctttggtggatagttgaagcatttgctgacacaggaggagaaacagacaggagaaagtgaagatgaaatcagtaatttctttttggctgaagtttgagatgcatgtcatccttagttatgtttagtggtcagttgagtggtgggacacaggtaaaaaatatggaaataatgtagctattaggaactctctgaactgactgaataagatcacccaagaagaaggttttttatagacaagggttgaatgccttagactgagccgcgggcatgcagctatatagaggtgagccgacagaagtacgggaaggcgaagaaaagaatagagaagatagggaaattagaagataaaaacatactttttaaaaaaaaaa

SEQ ID NO: 14054 - DNA, 603 bp, Homo sapiens
tgtcactgtgacacacctagatgtgtgttacttcaattaaaattctcaaatttaattttgatttgcttcagcgtgggaaaatattctcaataatgtaaaataattaaggtctatacatgggttgtatttttctggttcacaacagcacaaagtgtctttcacttttttgttggttttcttttaagatcttttttaccctgaagtcggtgaatacttttctagtttatttgatactctttctgtgtatatattaagcttttgctgtagattgcctagtaaaattactaaggataggtgtttttacatatggtctatttaagctgatgtttacgggggaaagtgtagttactaaaaatgtttaacataattggaagaagagtatgaacaccaataccaatacctatgcgttggattctaagaccccagttgtatccctaactagttatctaaccatatcatctggttgggggccattatttaccttccttatgcttatagaaaatgggtaatatttaggcaaaatactttggaaagacttccacaatactgtttgacactgcaaattaggtacctgcggcattgggctctataaaacatgagtaa

SEQ ID NO: 14055 - DNA, 627 bp, Homo sapiens
gtgttaatactaaggcactattttctcatctattaaatggaagtaatacctatcccaaaaattgctctattacatgttataatgaataaacagcctcatttaaagccagaaacatactaggtggtcaataaatgatatgtatccttgtaattctcttattaaaacaaaatttatttcatatatatcagctgtaaattttacatccctagattagtagtttaaaaacatttgttgctataggagattttatttaattattatttttgttttgttttgttttggagacagagtcttgctctgttgcccaggctggagtacagtggtgtgatctccgctcactgcaagctccgcctcctgggttcatgccattctcctgcctcagcctcctgagtagctgggactacaggcacccgcaccacgcctggctaattatttttggatttttaatagagacggggtttcaccgtgttaagccagaatagtctcgatctcctgccttatgatggcccacctcggcctccaaaaggctgggattacaggcttgggttatttaattattagaggaggctatacaatataaaggcaatatgagagttattctcctggttaagccaaaaaaaaaaaaaa

SEQ ID NO: 14056 - DNA, 181 bp, Homo sapiens
caaataaacttaccttccattaagtgttcaagcatgtctagcattattaggagggagttacgaaacagactttttcatcctttgtgatgaagcctgaaattgtgccgtgttgccttatatgaatatgcagtatgggactttgaaataatgattcataataaaatactaaacgtgtgtccta

SEQ ID NO: 14057 - DNA, 340 bp, Homo sapiens
cgctagatgatttgcattctctcacagagttaacggataaaaatttagaaaacttgtaataatcctgacttctttaataaaatgtgccctgtgtattgcttaaatccatagtccagccttttctgagttcttgagccatgagatggaggtggcctgtgtaatctactatttttagaaagttaggaaagcaaaccaaatactctctgagaggaccctatgaaatggctgtacccttcagctgtgctgcttcagactttggccaggctcccaggtgacttacgttaatagcagacttctagttagaagaggagaatttatttcataaaaaaaaaaaaaaaaa

SEQ ID NO: 14058 - DNA, 700 bp, Homo sapiens
cacagattgaagtcacctttgagatatatgtgaatggtattcttcgagtgacagctgaagacaaggttacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatcagcagaaaaagatgagttgtagactgatctgctagtgctgtaatattgtaaatactgactcaggaacttttggtagggaaaaaattgaaaagaacttaagtctcgaatgtaattggaatctcccctcagagtggagttggaaactggctatagccctaagcgggttgtttactggcttttcaattagcagttgctcaacatgtcttttgggtgggggggggagaaaaaaaattggccatct

SEQ ID NO: 14059 - DNA, 352 bp, Homo sapiens
actgtactcattcttgggctgcactgataaattttaatgtatccagaaagcttaccagaatggagaaggcactagaaattgcatcataaaaggagtgacagaagaacctggaggatatttcgcctgaagagtaaacttaggtgtgacttaataaatcattacaaatatcggtaattgaaagattatgtaagagagggaaatgtggatgaggtaggatgtgccaactaatgtttattgaacctttgtttatactgtactgagcttttcttctcttcagtagagtttagtccttaatatgcagtaagtcaaaattagcatttaaagttagtattgctgtgaagagggagttgtg

SEQ ID NO: 14060 - DNA, 455 bp, Homo sapiens
attgaggcagccagcgcaggggcttctgctgagggggctttcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagcagcatgaggaaggaaaagataaaaggtttctaaaacatgacggaggttgagatgaagcttcttcatggagtaaaaaatgtatttaaaagaaaattgagagaaaggactacagagccccgaattaatacccatggaagggcgatgcttttagattaaaatgaaggggcttaaacagctttaagtttagtttaaaagtgaaggtgattaaaataactttgaaggcgatcttttaaaaagagattt

SEQ ID NO: 14061 - DNA, 379 bp, Homo sapiens
aagatgcaaatgttttgaaatgatatgaccaccatttcaagtaggaaagtcatccaaacacttctgctttcacttaagtgcctggcccgcaatactgtaggaacaagcatgatctcgttactgcgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcca

SEQ ID NO: 14062 - DNA, 387 bp, Homo sapiens
tttgcaggcatcgaaaacaaatttggcctttatctcccgaaatttaagtctcctagtgttgctgtggttcaaccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagttttagtccttatgtgttgaaatgtttttgtaagccttggcatgaattagtgttctagactctgctttgcacagcttgcacttacagtga

SEQ ID NO: 14063 - DNA, 330 bp, Homo sapiens
atcacagaaattctactcttgtagagagtgctgctctagaagctttaggccactgaagttgtattcagcgacctgacatcagagagtttttgtagtcacttgagcagaggtaatgcaatccctggggaagacttccagtttcaattacattcaggttaacaaagcccattgttccaaccaaaataatagttgctcaacattccattctgatgatttttttttatccaagcagtcaacatagtttcattaaataccacccactaattgtgtactagttaaatgaggaatgaatgtggctctgtctccagataaatgaatagagagagagac

SEQ ID NO: 14064 - DNA, 401 bp, Homo sapiens
cttcatttctccaaaatattttcaaattagttctttgataatttgtcttcctattattttcctttctttttggatctcctattatgtattatttctctctcgtttttcaattctttttctttcctttctatctttctgggagattgctctgactttactacaatgctttgatttgattttttaaattttggcaaacttatttttaagaattcttttttttttcttttcttacggttacggtccccctcaaataagaatgccttatcttcctttccaggaatattgaagataaataagtaactctaaggtgtaaatcaatgaacttgactagacactgtcacaaaactcataacaatagtaatcttaagcagttttggtgggagtgacagaaacccaattca

SEQ ID NO: 14065 - DNA, 202 bp, Homo sapiens
agagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgaggaaaaaaaaaaaaaaaaaaaaaaaa

SEQ ID NO: 14066 - DNA, 540 bp, Homo sapiens
ctaacccggaaagggaatacttccaagttgtagtgttgttgttttcagcctgctgctgctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggtttggataccaaaaactacaagcaaacatctgtctagatgtattgatggaatttctggctttctaaatgattttactttctgccttgaattttcaaggcatagatgtcaacttacagaataacatgttttaagataattaagttcaaaaaaaaaaaaaaaaaaaaaaaaaaaaaa

SEQ ID NO: 14067 - DNA, 496 bp, Homo sapiens
aattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttggggaaggctttaaagacgcatgtt

SEQ ID NO: 14068 - DNA, 540 bp, Homo sapiens
caaaatatacattttataaaggacaaactttgtgttatgttttatttttcattacattgtataatattgtaaggctattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacacgaa

SEQ ID NO: 14069 - DNA, 317 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaaaaaaaaaaaaaaaaaaaaaaaa

SEQ ID NO: 14070 - DNA, 535 bp, Homo sapiens
gcttttcctccttggctgtctgaagatagatcgccatcaggaacgacaccgtcactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaagggcaatgttggtgctggcaaaaagtgagctggagattggatcacagccgaaggagtaaaggtgctgcaatgatgtagctgtggcactgtggatttttcgcaagaacattattaactaaaaacttcgaaaaa

SEQ ID NO: 14071 - DNA, 494 bp, Homo sapiens
gtatcaggagcttctggaaacagagttcctttccttagctgaaaagaaccctaagagtagactgcctgggatggcatgggggatgggaggatcactggacctgtgggccagaaacttgggtttgagtcccagctctggctttgctgagttgtgtgactctcagaaagtcatccaacctctgtggtccttattttcagtgataggacctgtggggaatgattaccttttagtcccatcctatgacagtatggtttgttttcaaagccaggttagcactgacttctccctcttgtgttttcagagtgcctttgcattggtttggctttggctacgcagcactggttgcttctgggtgggatcattggctatgtaaaagcaggcagcgtgccgtccctgggctgcagggctgctctttggcagtctagccggctggggtgcttaccagctgtctcaggatccaaggaacgtttggggttttcccaactacatctggg

SEQ ID NO: 14072 - DNA, 525 bp, Homo sapiens
ataacatcactgagaacaagattaatttatttaaaaatatacctttgtagcacagtgagcattttaaagagatgaggtgatggattcatttcattgtcttgttacactggtcatttgtacttttgacccaagttaaagatttaaaagttgaatgtattcgagaaaaatgttactagatttctgagaagggttgtgtaaaaacgccttaagagcagatggaaaatttattggcattaattaaaattgatttgacatactattggtggtatggtgcacagtcagaggccttttttgtaaaatggtcatgtatcagttgtgggacagacggtgcaaggttgattatggcagagttctgttagtcacagtacactgcttggcatgtttccattggcccctactgtgttgagaaagtcaatgagaagatgcacctgtcaaaattaattttcagggtctagtaacctcagtgtaggatttttagacagtaataaatgattaacacttcaaaaaattttaacttttctttgt

SEQ ID NO: 14073 - DNA, 344 bp, Homo sapiens
gccttagaataagaaaagctttttttaaattgctctatctgtatatctgaactcttgaaacttatagctaaaacactgggatttatctgcagtgttcagggagataattctgcctttaattgtctaaaacaaaaacaaaaccagccaacctatgttacacgtgagattaaaaccaattttttccccattttttctcctttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaa

SEQ ID NO: 14074 - DNA, 460 bp, Homo sapiens
gtgctttgggaccagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtgggtccagtgttctgatttgggtctggacaaagtaccaaaggatcttccccctgacacaactctgctagacctgcaaaacaacaaaataaccgaaatcaaagatggagactttaagaacctgaagaa

SEQ ID NO: 14075 - DNA, 193 bp, Homo sapiens
tttgaatacacaacgtccccacgtccccaaattgtggtgctgggatagttcctctaagatgcattctgattttgaagttcaaggtctctaagcgctgttaagcggaaccatgaaaaatacgttgctacattaaagataaaacagacggtgatactgactgcagaatcgtagtagaaacttttttttttttttt

SEQ ID NO: 14076 - DNA, 213 bp, Homo sapiens
aactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaaaaaaaaaaaaaaaaaaaaaaaaaa

SEQ ID NO: 14077 - DNA, 630 bp, Homo sapiens
tatcgctatgattcggtaggcagtaagagatgcttaaatctgagatctgtgcgctatgcatatacctgcatgcatttgactgtttgagaaaagttgcagcattgaccagattttcaagagatcattaaattgtgttatcttttttccatctatccctactttttcaactttgtggtcacagtactgccattagagtagatggaaaaaaaaccttgtgtatttagcttctgtttttgatctctctgcatagcttgttctgaattcctttgaagagattcaatgcatagcagaccacagtacacctgaggtgaatgaaagtggagctgcagtgtttgttgttgcctatgttgcaagactttgctttttgtggcccatagatggtgaaccattacattttgatctgtatatttctagttttatctcaaagaatgtgggtttcatccctatggagtttttaaaaagcaaatgcaatatttagtctgtcgataagaaggattgctaaaagttagattcttaaaataatataccctagatatgatacaataattctttttggctgactggcttctgagtaatatatttgcagcaaactatgaacctactaatggatttatagagagtgatcaccgg

SEQ ID NO: 14078 - DNA, 575 bp, Homo sapiens
caaaacttgctacaaagaccagttcaggtcaaaaaagtatgcatgaatcaaaaacatcaaggcaaattaaggaatcaagatcacagaaacacacacggatactgaaagaagtagttactgaaaccctgaagaaacacagtattaccgagactcatgaatgtttcactgcatgcagccagcgtctctttgaaatctctaagttctatctaaaggatcttaaaacttcaaggggctatttgaagaaatgaagaaaacagcaaacaacaatgctgtacaggtgattgactgggtattagaaaagacacgcaagaaatgatacataatcattctctttaagacaattataaattggatggagctattattcactacttcttttcttagtttgaaaattataaacaaattttaagctttattcaaagaatagatgttatgtttctaaagaatctcatggatatatacctctatattggtatagtgtggggggaggccaatggttaaatggaattttttaattaggataccataatttttggtaaaagggggaacctaatattttgaaaaggttattttct

SEQ ID NO: 14079 - DNA, 381 bp, Homo sapiens
tttcttagcttctttcataaaaaccactgaaatgaacaaagaactctaccgtatagttaatttcagttctagtgggagttgattaaaatggaacgtagatcacatatacgataaactcttttttgtcagcaggcaattccttttagttcagcttaatgcattttattcccaataatgccaaagaaacatatatgtcttagatgctccatatctaattatgtggctggatacattaataacccataacgttacatagatttgaggactaaacacagataaaagccagagaaggtgccattatttgtagccagcaagttgcatgatccagatgctggagtatctgcctgtctttccacctttgttccttcagaggcgttggaa

SEQ ID NO: 14080 - DNA, 697 bp, Homo sapiens
aagaatccaaatgaaaacacaacatacaaaacttatgcagataaagtagtatttaaagggaaatgtataactataaatgtctatattgaaaaagaaaaaatatcttaattacctagctgtgataggttgacaaaagtttctccaaaagatatccatgttccaatccctgggactggtaaatattttatttgaaaaaagactctttgcaaatgtgaattagttaaggttttgagatgatgggtttatcctggattattcagatgagccctaaatttgataatcagtaacctcctaagagagaagcagaggaaggttacacacacatgaaaatgaaggctgattttggagtgatgcaatcacaaatcaaggaatgctggcagctccaggagctggaagaagcaaggaacagattctcctctagagcctgcaaagaagtatagccctgctgcaccttgattttgcctcgagtaagactaattttggcttctggcctccagaattgttagagaataaggttctgttgttttaagccattgggttataataattggtatagatacagtatattggtatagatatatagatatggaattattatagatatggaattggtatagataccgcaccctaagaactcaaaaggagagcaactacctaagcaggggaagaaggaaggttaccctgaataatggggaaa

SEQ ID NO: 14081 - DNA, 214 bp, Homo sapiens
ccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaagg

SEQ ID NO: 14082 - DNA, 536 bp, Homo sapiens
agcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttcttgtggcaaacaacagactttttggtggatccattccgaagaataagaccct

SEQ ID NO: 14083 - DNA, 458 bp, Homo sapiens
agtgtgctgtatgctgtcttcacttgagatagaaactgctgtcatctttattttatagaatggagagaactgggtctcaggaaagtataataaattgcctaggctacaacaggtagcaagtagcagagtcaggatttcagtccaggcagcctggccctaagagctgaggctccctctactttgtttcttatctggtgggtgaacaagatttgagttgctgtatcttccaaggtagtattataatagtatttcaaagactagctgactttttaatgtcaacagtgttccaatttgctttctccttaggccctaattcattgcagagataaggccatcacctttatatatgagacatttaaacaaatggttttaggaataattcaggaaacatacaaccgggattccttctgtagcgatatctgcagtctcttggtataaaaagactctattaggttaag

SEQ ID NO: 14084 - DNA, 262 bp, Homo sapiens
agatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctagggaactgctatctgatgcccctcaatacttctattgttatgcctccaaaaaa

SEQ ID NO: 14085 - DNA, 361 bp, Homo sapiens
gatgagatgagatgaaatgagatgcaataatgagatgaaatgcgactaacgagatgagatgagatgaaatcatgagatgaaatgatgaaatgaaatgatggatgaaatgatgagatgaaatgtaatgagatgaaatgaaatgacaatgaaatgaaataatgaaatgagatgaaatgaaataatgaaatgatgagatgagaagaaatgatgagatgaaatgatgaaatgatgagatgagataaaatgagatgaaatgatgagatgaaatgagatgagatgagatgaaatgagatgcaataatgagatgaaatgcgataacgagatgagatgagatgaaatcatgagatgaaatgatgaaatg

SEQ ID NO: 14086 - DNA, 122 bp, Homo sapiens
atatgaaacactacaaatttattcttggtgaagatgatacctgaagctgtcacctcgtgattatctaaactaagcgctcattctattttataaaacaaataaattagtcctcttttttctga

SEQ ID NO: 14087 - DNA, 326 bp, Homo sapiens
atacagtagctggggaaaatgccagaatgtacttgccatcagatttgattgtgaacaaggactgactgcagaaaataatggaaaggatgtttaactcttttatctccgaacattgaatgagataaatttccagatgctgttctctattttaatgttattggaccaatgttctgtacaaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattgg

SEQ ID NO: 14088 - DNA, 392 bp, Homo sapiens
atgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcctttagagaattttgactcccagatcagtcagagcccctacagcattg

SEQ ID NO: 14089 - DNA, 606 bp, Homo sapiens
gtggttctgaaggtgtacccaacatgtccgtggacacctgtgcctgccggtgagaccactccagggtggaaagaagccacgcccagcagagctgccttctcggagccttctgcaaccaggacttgtggtgcagctgcagacacagagcacagctcatgggcaacatcactggggcccagagagagctgtccgccagtgcatcattagggggtctttcattgctagtgactagccccttaaatgccagcctgagtacctgaaggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttggggccacatagtgattttgggaaaacagggataatcgtggtgtaaatgagtgtttcctttcaaagtccactgcagagcttttatccatatggtatgcacatgtagccaatattgggttccttttcctaatatatatattta

SEQ ID NO: 14090 - DNA, 536 bp, Homo sapiens
agagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgccacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagatctataaattctacttgtctaagacagtaaatctgtgttaacaagtagtaataaaagttaatcaatctgg

SEQ ID NO: 14091 - DNA, 499 bp, Homo sapiens
gagtgatggaaaacacatgagcagtaacaagttttaatcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatacggaagacacagatgatgatgatgatgatgatgatgatgatgatgatgatgatgatgaggacaactctctttttccaacaggagagccaagaagccatttttttcca

SEQ ID NO: 14092 - DNA, 644 bp, Homo sapiens
ggtcactttttacgtgagcgtataatcccaagatcagtgttatattttactggagaagctattgaagatgatgatgatgattatgatgaagaaggtgaagaagcggatgagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagttggtgtttttgaatatcaagtttctctcgttaaagtctttaataaataaagcctattgactggataactttggtttttcagtcccactggcatgtgaacagtacacataattcagtgggacgttttctaaaaaaacattggtttttggttggg

SEQ ID NO: 14093 - DNA, 231 bp, Homo sapiens
aaatgtagttattttgacaagtgtgatttgtttttaattaataagatatcagactatactagtaactgtcctgttgataattttgttcaccacatggacatctgataatgtgtcattatcacatcagcacacccctacgcaactcatgctttagtcagatgaaggatttgctttcatgttcaagtgtgccttaccaggatagctggccaaaaatgtgaatattacaattaa

SEQ ID NO: 14094 - DNA, 538 bp, Homo sapiens
gagtactaacatggactaatctgtgggagcagtttattccagtatcacccagggtgtagccacaccaggactgtgttgaagggtgtttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacaccgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatggtcagtgctaatcacgagttgtacattgctcagattagggttgacctcagtcccaa

SEQ ID NO: 14095 - DNA, 567 bp, Homo sapiens
gctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacgggaaaggacagattgttcctaaaccagaagaggaggttgcccagaagaaaaagatatcccagaagaaactgaagaaac

SEQ ID NO: 14096 - DNA, 590 bp, Homo sapiens
attgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtgggaaaaatatgtatgtgttatatactcaaatgtatataattctatctatagatttatatatgtatacattctgtacagtagttccatcaaaatatgtataattcacaccaatttt

SEQ ID NO: 14097 - DNA, 328 bp, Homo sapiens
acatgtctgtttcttttaataggtaaaacgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaact

SEQ ID NO: 14098 - DNA, 406 bp, Homo sapiens
aggcaagagccaagaacagttggaagggaacatcagaggaaataggcaaataatagtaaataatggtaagtaagacttgggagaaagaaggtagatttggggctgaggaactagcctaacactggaactttagtagtagccaagtaggatttgtttcaatgttcagaacttgagggtgataagacctgagccgggtcttaagaaggaaaatgtggatggtctaaatctggaggtattgaggtgggaaggactgaagcagaaagacaggagctgagacagcagtgacagtggcagcagcagaactagagaagagtatctgaggagaggtagggggagtgagtggaggtggtaggagcctgcagggagaaggaggcactaaaggtggatcagagactggttcatttag

SEQ ID NO: 14099 - DNA, 688 bp, Homo sapiens
gtcgtgttactcgctgtggtggagcttactggaagccgttttcgattgcttttcctggctgtagagcgctttgcccctggcgggtgagagtgcagagacgaaggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtaagagtggtgcaaagcttcttttacccctctttcttacatccaaggactgtctcatcgaaatctgctgggagatgacaccacagactgttccttcatttcctgtatattctctggactatgtcgattcgcagacattcagaagattctcggcttgccccttcacgagccggcaccaaggaggcaggtgggattctttggcccaccaccttcttttggaaggtctcttgaactcaagaacttttattttctatcattcttctagaccacacacatcaaactggcaactgtttgtagcaagagcctaggaagcctactcttggg

SEQ ID NO: 14100 - DNA, 127 bp, Homo sapiens
caacatagtgcctatagttaacagtcaggtattgagtatagtctgccctccgtgtgtgggttccacatttgcagatggaaccaactggatagtaaatatttgggggaaaaaacaataaaaaagaaca

SEQ ID NO: 14101 - DNA, 548 bp, Homo sapiens
gcaggttacgcattaggtaaggggttctaattattcctgttagtcaagaaaattaacaaatttctttgtttaacaaaagattaatctttaaaccactaaaatacatagactgattgattattcaacacattggaattgatgtcggtcatagtttcctgaagcatttagttacaacctgaaggaatagaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctcctggaggggacttccacacctcctgcctttaagccatgggtggaaagtgctcagtgaagtacacctgtgtgg

SEQ ID NO: 14102 - DNA, 386 bp, Homo sapiens
atgtaggaagcacctggaaaatattcgctgtgattaccgtcagtccattttaccgaggaaggagccaaggtccaggcccactgaaggacttgcataacattacaatagcagtggcagaaccagccatgcttctgcaaatcacaacctctttgagcctctgtcacctgaactgcaaaatgagtgggttagacaaaatcatctgttgggacctcctagttccacgtgctatcattctactaactggcaccctaaggttgaaagtgcttatctgctttccaatgtggcttccttacagtctggaactgacaatatgcaggagcagtaaactggcagaaaaccaggaatcagagaaagaaaatataatttaactttaaagatgtaaatta

SEQ ID NO: 14103 - DNA, 168 bp, Homo sapiens
tggcaaaattagtcgccttcgtcgagagtgcccttctgatgaatgtggtgctggggtgtttagggcaagtcactttgacagacattattgtggcaaatgttgtctgacttactgtttcaacaaaccagaagacaagtaactgtatgagttaataaaagacatgaaccg

SEQ ID NO: 14104 - DNA, 493 bp, Homo sapiens
ggagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattcagttatttatttcaaaatgtttggaaacagtataatttgacaaagaaaaatgatacttctctttttttgctgtccaccaaatacaattcaaatgcttttgtttattttttacaa

SEQ ID NO: 14105 - DNA, 242 bp, Homo sapiens
caaagtctccaagaaaacacttctgtcttgatggtctatggaaatagaccttgaaaataaggtgtctacaaggtgttttgtggtttctgtatttcttcttttcactttaccagaaagtgttctttaatggaagaaaaacaactttctgttctcatttactaatgaatttcaataaactttcttactgatgcaaactatttaaaagaaaattgagagaaaggactacagagccccgaattaaa

SEQ ID NO: 14106 - DNA, 489 bp, Homo sapiens
gggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccgagcagagtggccctcatccttcagaatgtgggtctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggttaagcaaatacagcaaacttttatttaagtagatgggagaatatgtttaaaatattagggatccta

SEQ ID NO: 14107 - DNA, 297 bp, Homo sapiens
gttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggcatataaagaatttcttcaggttgaattacctagaagtttgtcactgacttgtgttcctgaactatgacacatga

SEQ ID NO: 14108 - DNA, 550 bp, Homo sapiens
gctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaggtagacaaagaagccgaaggagccacagccggaacagccacagccaagtacaagtgcaaattaactggtcaagtgtgtcagtgactgcacattggtttctgttctctggctatttgcaaaacctctcccaaccttgtgtttcactccaccaccaaccccaggtaaaaaaagtctccctctcttccactcacacccatagcgggagagactcatgcagatttgcattg

SEQ ID NO: 14109 - DNA, 224 bp, Homo sapiens
gaaggcgaaagggagggagaggaggaagggagggaggtggaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacag

SEQ ID NO: 14110 - DNA, 563 bp, Homo sapiens
gagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaaagtgtatttgttacttt

SEQ ID NO: 14111 - DNA, 173 bp, Homo sapiens
agatttggttactgaaggagcagctgtttgccaggtatggtatgctactgtttgagatagacactttgatgcaaaatgggacgcttgatggtgatggacttgaaaaaatggatatgcgatgtgtgtttaaatttctcaagccctataacaataaacattttacaccccaatga

SEQ ID NO: 14112 - DNA, 516 bp, Homo sapiens
atattgttgaagggcagttagtttccagtttttgtttattacataatagcactctctgaggcatgtcttttggtaaacccatgtacacatttttctcaggtacacacctaggtgtggcaatccactggtcactgtaagacaggtgagtgtttaacttaaagagatgcagttaactagttttccaaagtggttgtgccaattactctttcattcatatatgaaggttcactgggagcaatgttttttgattcactgattgagaaattaaaaagagaaatcctataatctagctcatacatccaattcaacaaaagtgtatcaattacgtgtcagacatttgtctacccttatgaaaattatgttccagttgaaggagaaaagcaacacggttaaagatacaatggttggttttaagtgctagggacaaagataccctagtatagagggaatatagaggggatatatttatgctgtaatggtgggtctcactatctttgacttacattggtctttccg

SEQ ID NO: 14113 - DNA, 581 bp, Homo sapiens
ggaggcattgaggcagccagcgcaggggcttctgctgagggggcaggcggagcttgaggaaaccgcagcataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcaggcgaaaatggaaagattaattgggagtggt

SEQ ID NO: 14114 - DNA, 550 bp, Homo sapiens
catcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggacaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagctttgcttttcctttg

SEQ ID NO: 14115 - DNA, 361 bp, Homo sapiens
tttgtttgtttgcttgagacagagtttaactcttgttgcccaggctggagtgcaatgacacgatctcggctcaccgcaacctctgcttcctggcttaaagtgattctcctgcctcagcctctcgagtagctgggattacaggcatgcaccaccacacccagctaattttgtatttttagtagaggcagggtttctccatgttggtcaggctggtcttgaactcccgacctcaggtgatccgcccacctaggcctctcaaagtgttgggattacgtgtgtaagccacagtgcccagcccgaattggatatctttaagatatctgtaagtgttatatccctaaccaagaaaaaaaaaaaaaaa

SEQ ID NO: 14116 - DNA, 450 bp, Homo sapiens
tagaagacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgattttttttttttctggagtgagactctgaagaaccttttcgataatgtttggacttggactaaagcaattagaattatgaggcaaaaaa

SEQ ID NO: 14117 - DNA, 192 bp, Homo sapiens
ttcccgttagtccaaactcaagaggcagcacggagcgtggtctgcttccccactactcacggctctgcaaggcgggcaccaagaggccaacccttgccttcgccggaaaccctggagaacggtgacgcgaaatccacctgtttgcctcatccccaagcaaacagaaccctgctgtaagtcaacgaaaagtct

SEQ ID NO: 14118 - DNA, 532 bp, Homo sapiens
aaggaccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctggg

SEQ ID NO: 14119 - DNA, 340 bp, Homo sapiens
aagaagtggagcagttgatcaaaaaacatgaggaagaagaagccaaagctgagcgtgagaagaatgaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttcctcacacatcccctttttttggaataaaatttggaaaatgg

SEQ ID NO: 14120 - DNA, 221 bp, Homo sapiens
acagtggaatagggggtctccctggggaatgcaggccaagtccttttattttaacatgatgtccatgaagaggtttgccgtctgggcagccctgtcggtaaggagcgtgcatactgcgtttgtgtaattgtttgctgtatctcccgtccctctgagctgtattgttctttaatggctgtcttgcccttccaaaaaaaaattgaaaaaaaaaaaaaaaaaaa

SEQ ID NO: 14121 - DNA, 347 bp, Homo sapiens
aacagctaaggactgcaaaaccccactctgcgtcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccccaaaaaaaaaaaaaaaaaaaaaaaaaaaa

SEQ ID NO: 14122 - DNA, 381 bp, Homo sapiens
gaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacataaaaaacccttcgaaaaatcaatgaatccaggagctggttttttgaaaagatcaacaaaattgatagaccactagcaagactaataaagaaaaaaagagagaagaatcaaatagacacaataaaaaaaaaaaaaaaaaaaaaaaaa

SEQ ID NO: 14123 - DNA, 602 bp, Homo sapiens
gttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatggggcttgctgacttagccaaagaagagttaagaagaaaatacacacaagtatacagactgttcctagtttcttagacttatctgcatattggataaaataaatgcaattgtgctcctc

SEQ ID NO: 14124 - DNA, 299 bp, Homo sapiens
ggaggaaggattgtaaaaaaaaatgcctttgagacagtttcttagctttttaattgttgtttctttctagtggtctttgtatgagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggga

SEQ ID NO: 14125 - DNA, 595 bp, Homo sapiens
aatgagaagactgatcaatctgttacggcagtcccagtcctactgcacagacgcagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctatgttactgccattcctatttacagtatatttgagtgaatgattatatttttaaaaagttacatggggcttttttgggttgtcctaaacttacaaacattccactcattctgtttgtaactgtgattataattttgtgataatttctggcctgattgaaggaaatttgagaggg

SEQ ID NO: 14126 - DNA, 535 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcaaagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtaggggtataataatgttaacatggacatga

SEQ ID NO: 14127 - DNA, 228 bp, Homo sapiens
atatcacacgtatataaatgaggagttgtgaagttgaagcctgagcaacaagccaaaacccccgtttctacaaaaaattagccaggcatggtggtgtgcacctgtggtcccagctaccagggaggctgaggtgggaggatcacttgagcctgggaatccgaggttgcagtgagccaaggtcgcaccattgcactctagcctgggcgacagagcaagaccctgtctcca

SEQ ID NO: 14128 - DNA, 415 bp, Homo sapiens
gaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaattaa

SEQ ID NO: 14129 - DNA, 516 bp, Homo sapiens
acttgtaaacagtcagctttcatgagaagtcacttactatcgcgaggccagcaccaaggagatggtgctaaaccattcatgagaaatctgccccatgatccaagcacctcccaccaggctccacctctaacactggggattacaattcaacatgagatttgggtgaggacacagatccaaactatattaggcatccaggacaatgacaagatagtgcttaccatgatacttggcatttgttcattcaacagcagctcagcaatcactaggtcaggtcaccattagccttagggatttgtggctaacaagtcaggcagatcctgataaagcagtaagtgccaggataagagaagtgcatggatctatgagaacgtatagaagcaacactgaattcaggcttgcaggcatcagaggtcacagagctgaagatgagtaggaatgggccaagttggaattgactgaggagagaggggataaatgatagggatgtctttagagtggaagaaatagcatagc

SEQ ID NO: 14130 - DNA, 616 bp, Homo sapiens
cactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaatttttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcctgaaaaaaacaccaaggtgacgtttaaaatttttagtacatatcctcaaattggagctaagttatacttcttttataacctttgggcatctggtcgagagaagacaagattttctctatttacagtgag

SEQ ID NO: 14131 - DNA, 510 bp, Homo sapiens
aatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccattttaattaatatttcctctgtttattcctcctccccctcccattgcatggctcacacctgtaaaagaaaaaagaatcaaattgaatatatcttttaagaatccaa

SEQ ID NO: 14132 - DNA, 109 bp, Homo sapiens
gttacccttttcctaatgaatcttcatttcatgatattttcaccaaagaacaatagaatctgtaaaaataaatacttgcagtgcttaaatgggaaaaaaaaaaaaaaaa

SEQ ID NO: 14133 - DNA, 443 bp, Homo sapiens
ggggacaggagataaaagaattagaggacctgtccaggatgtccaatatttgaataatgggagttctaaaaagagtgaacaagggaaacaaaaggtaattattcgagaaaatatccctgcactgaagaatgggagtttctgcactgaaagggccagagatggtagctgcaaagagacacatcgagagctttaagaggtgaaagttttggcctctgtgcagaggaagtggtagggacaggtctcctcttggcttcctttaaacaagccctgaagaatattcaactcttcaaattattgcatgtataacgatttaaaaaacaaaaactttggtaaggttgaaaaataaaagacatcaatagatgttcatgaaagagaaaatccaaatgccaatgaatctgagaaaatccagagattgtctcttaaactggacatgtgttgtgaca

SEQ ID NO: 14134 - DNA, 435 bp, Homo sapiens
aaaaattgaggcatactacgcagtttaatatggaaaatctggacagtaagtatgtcttttcatagttgacctatctgttgcgttctgttcacccctgggatgatgattattttgttacgacaaagcggtgattgcatttgtccgtatacatgctctctaaaatgaagctcagatgtgtttatgctaaggctcacctggaggatgagactgtcaagccggacacttatggtgtagactttatggctcccctttcagcaatggatggacgatccagagaggcaactcaacaaagaaacatcagagttcaactgcactgtagataaaatgaacctaacagatatttacaaaacattctatccaacaactacgaaatacactttcttttcaagtgcacatggaccagtttttagaatagactatgctgagtcataacac

SEQ ID NO: 14135 - DNA, 197 bp, Homo sapiens
agcctagccacacccccacggaaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaa

SEQ ID NO: 14136 - DNA, 503 bp, Homo sapiens
aatggttaagtgctcagtacttccataattagagagatctagacttgcttgtatctagcgttatgaccataggcaaagctatacaattcatacaatttctatgttttattttccacatctgtacagcgggactatactagagagttgatgtgagagtgaaaatttaaaaattatgtctaaagggcttattagcttagtacccaacaactagcaaatgtttcttaaaaatggtgcctgtgaacaataacagtaaagtcatagttgttgcattagcattttgcttttattatacatcattactatttaagcttttcacagttccgtttgcaatacacatataacttaatcctgtaagttcattccaagattgagagttaagatgtctttacaaatatgaaaaaaatgaagaggttagtttgcttaaattacttgctattcctaattttgatcaagtgttttcttaatattttgcattatttaggaagctaatttttcccatccga

SEQ ID NO: 14137 - DNA, 573 bp, Homo sapiens
gagtaaccttcggcaatctcaccttgaaatactgactcctgaatggcacatggagttgcggcaggcaccaccctgagctggcaccatgtttgtattactttagtcattgacatcttgcagcagtatcaccacctatgccccggggcctgcagatggaattgttacctttgtgattgacacttatgaaaatccgcaacatgtatttattataatagggggatctctgctaacttaaagcatttctagagtaatttactgtttatgcttagaacagactcttagggtgatgcaggagagctataatagctacatgctattatattaacagataatattataactagtagaatgtgaaagaaaccaacatattactgtaggtcaagggaaatgggttaagatctggtgcctccaccaaatctcatgggggaattggaaatccccaagtgctgggaggtgccggccatgggggggggggggaaccgaaatcaatgggggggccagggaattaagagggaatcctcttcaagggaccaaaacctaaaaaaccaaaaaaaccccccaaaaattcccccc

SEQ ID NO: 14138 - DNA, 357 bp, Homo sapiens
tccatgtaactttttttaaccatttaacaaggagggggtactgtttcctaccttctttgcatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctggattgtatttgaagactgtttgccataaatctgaaatttgaacctatgtatttcaatttgggatgctaaaaaggccgaattaatggaaaggttttgg

SEQ ID NO: 14139 - DNA, 547 bp, Homo sapiens
aaacaaatttcttttttacttaattgttttggtacttgctagcatcctacactgttccaaatagtctgaagcacaatattggggtgaagaactaaaaggagattgcgggagtatctggggtaaacatgtcaaattgtctactacttattttcaaaagatttggcaaaaaagaatatctagggagagaaattaaatagatattattcagatacatcactggataatacgtagacatatgagataaatgtggttaaatataacaactgaagaatctagaagatcccattctttcaactttactgaggtttgaaaatttccaaattaaaaagctgaagataagcctggaaccaggactgaaaagaaagagaataaagaatttaaaaagaaaaattattttttaaatttgaagaaaaattatagcagtcacataatactaaagaataaatactatctttgaaaatgttgggctggatgtggtgcacatgcctataatttcagcaccttgggaggccaaggcaggaggatcgctttgaggccaggagtttga

SEQ ID NO: 14140 - DNA, 423 bp, Homo sapiens
ggtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttaaaaaaaaaaaaaaaaaaaaaaaaaaaaaaaaaaaaaaaaaaaaaaaaaaaaaaaaaaaaaaaaa

SEQ ID NO: 14141 - DNA, 439 bp, Homo sapiens
caacaaggacaaactgcacttcacttacgtgttgatgtagttcataaacagacgccttttctcttctgcaaaaggtactgttaagtaaaccagattttctaaataggcattcttaaaatttcagacttacaaagctagtagtagaattgtattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattctgtgaaccgtgaagtacgtgagactagaagacgcccaaacaagtcagataatagtaactacaatggttgctgatgttgagattattgttgaactataattaataatttggatggcagaattta

SEQ ID NO: 14142 - DNA, 159 bp, Homo sapiens
acgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 14143 - DNA, 159 bp, Homo sapiens
ggagtgaaggcatcccctccagcacctttcagcctgctagttaggacgacccgccgccaccctccaggacctccagccctgcactgcctttcctctcttttaaataattcttcattgagttctaatatgcaaaaaaaaaaaaaaaaaaaaaaaaaaaaa

SEQ ID NO: 14144 - DNA, 226 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgagg

SEQ ID NO: 14145 - DNA, 316 bp, Homo sapiens
agcgtggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagagactgaggcacgagaatcacttgaacccgggagggagaggttgcagtgagccaagatcgtaccactgcactccagcctgggtgacagagtgagactccgtctccaaaaaaaaactttgcttgtagattatttttgccttaca

SEQ ID NO: 14146 - DNA, 533 bp, Homo sapiens
ctgaatgggacagaagcgaaattagtgcggaaagttgccggggaaaaaatcacggtcactttcaacattaacaacagcatcccaccaacatttgatggtgaggagggaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagc

SEQ ID NO: 14147 - DNA, 470 bp, Homo sapiens
gtggatgcatctgtaataagcctacataaacaggtgaagtctttcaaggattttgaagatttactgtttttttaaagcctatttaatgaaacaggttgtgcacaatccacacctaagcaccatacttcttaccttgtggccatacctcaaattgtttcttagctccttttctgaaaaatgattacaacaataataataaattcaagaaaaataagcatcaaaatactttcctctaacccctgcaaatgtatccagtataaaaattcccagtgtgcatatttaccttcctgtactgttcaagaaaacacggttgtgcttcattatcaaaagttcattctggtagataacagaagagaatgtgaaatatgcgaaaatgttttcttaggatagaatgaattggctaacatgggagttctttttttaataagatagaaacaagatagaaaatggaaatattgtcaagaggttca

SEQ ID NO: 14148 - DNA, 353 bp, Homo sapiens
taattgtgtaaattattaaaatattataattagagctgggtgcagtggcttaatgcctgtaatcccggttatttgggaggttaaagtgggaggatcacttaagcccaggagtttgaggctgcaatgaagctatgattgcaccactgcattccagcctgggctacagagcaagacctcatctcttaaatttaaaaaaaaaaaaggagagaaaaaatgctgggcaccttggcttatgcttgtaatcccagcattttgggaggctgaggtgggccgatcacttgaggcaaatcaccagcctggtcaacatggcaaaaccgtgtctctactaaaaaaaaaaaaaaaaaaaaaaaaaa

SEQ ID NO: 14149 - DNA, 567 bp, Homo sapiens
gcctctttttccggctggaaccatggagggtgtagaagagaagaagaaggaggttcctgctgtgccagaaacccttaagaaaaagcgatggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggtaacttctatgtacctgcagaacccaaattgacgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtacccaatctgaagtcagtaaatgaactaatctacaagcgtggttatggcaaaatcaataagaagcgaattgctttgacagataacactttgattgctcgatctcttggtaaatac

SEQ ID NO: 14150 - DNA, 606 bp, Homo sapiens
ggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagta

SEQ ID NO: 14151 - DNA, 643 bp, Homo sapiens
ggctttaagaattaacgaaagtagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattgggtaaacccgaccttcatccatctccagcacaatcggctgaaagaggatgctgtttcagctgcttttaaaggtctaaatcactcgaataccttgacttgagcttcaatc

SEQ ID NO: 14152 - DNA, 642 bp, Homo sapiens
aaattatcaaagttaaaggacccagctgcctcactaactttatttaaggtacagttacttcagtttctttttctgtgaaatcgagttgaaaatatctttgttttgaagatgttagaaatatgtaaaatgtgttttacagatgttaatgtgtgtattatactttattaaatccccctaatttaatgagctttatacttagcaccagtagtaactacatggctcattcacagtatgatatagataaccttcccatatattctttgtcactgaacattgacaccctactttttatgtgtgcaagattctgtgtcaggtgttggaaacatgaataaaacatggtttatagcaccaaagcaattacagaataagggaattagaaatgtagacactgaatccacattttttacagggactatagtcaactgatttcataatcaattaaaccactaatatcatgtatatattgcattatgggattttttttgtgaaatgctgtatcagaagagaatctggacctattctcaaggtgaaatagcactttattctgctattctcaaacagtaagtcattaaattatcttcataaatgtaagcagtaagtaaactctaggacagatggcagccttttcataaatctatattt

SEQ ID NO: 14153 - DNA, 522 bp, Homo sapiens
atttaagaagcaagaactgatgttacagaatacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcctaaaaagattgaatcagtaaatttcatttcagctaaaaatggagtctaatatattgtttcaaaagatacatttttacccaccataaatgtaca

SEQ ID NO: 14154 - DNA, 586 bp, Homo sapiens
ggagggacagacgccatcatagaactggaagattatttcaggatttcatccatccttagtctacctagtctacctaccatgttgccacgtttattacagtaggtgctcaagacagctctgaatgaatgagttgtttgttccctcttacacatacccacccctaattaaaaattcaaatcatttttgtatcaatattgtactttgaaaagatcttctgaattgatggcttctaacttcaggttgttggccagatctggatgtggtcagataaggtagatgtaactgtttcctgagtctaaaacctatcaggatgcactggttgggaaatggatagagcaccttagtgtattttctgagaaacacagatcagtggttttgcttacctgtgtgttgataatgagtgctttttctgcgtgcgtactttatttcttcgaaataggacttacgtgaaaacaaagtgggcttaatcattcaattacagtttcctctatgaaatttttcaataaaaatgaaataaagcaggggagctctaagtctgtttcatactctgcagtatggatgatcaccaggaaacatttcttaatgg

SEQ ID NO: 14155 - DNA, 536 bp, Homo sapiens
ccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacgggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaagggaaagg

SEQ ID NO: 14156 - DNA, 162 bp, Homo sapiens
ctccttttccagtgctgcacactcctgtgtttggaactttaatagcgttgcaacgaaatcctatatccagtttcctgtaatttaattgaagaaaaatacatccaaataaagactttattattaacagaccagatagcatcagaaatcatgtgactgttatga

SEQ ID NO: 14157 - DNA, 210 bp, Homo sapiens
aaaatacaaaaattagctgggcatggtggcgtgtgcctgtaatcccagctactcaggaggctgaggcaggagaattgcttgaactcgggaggcagagtttgcagtgagccgagatctcgccactgcactccagcctgggtgacagagccagactccctctaaagaaaaaaaaaaaagattctatccaataagagcattactgagaagata

SEQ ID NO: 14158 - DNA, 604 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgggaagattaatttgggagtggtaggatgaaacaattcggagagata

SEQ ID NO: 14159 - DNA, 507 bp, Homo sapiens
taagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcagaaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttcc

SEQ ID NO: 14160 - DNA, 212 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccaggtagggtctgaaaatcgacagtgatcagtttgtggggtctgggaaagttttttttttttcccttttttaaa

SEQ ID NO: 14161 - DNA, 430 bp, Homo sapiens
ggaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcagaa

SEQ ID NO: 14162 - DNA, 615 bp, Homo sapiens
gggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaaggacacctacaacaagctgaaaaacaagggatgggcccagcgggaaacgctgaaagcatccactatgcgttgaactgctgtggttggctgggggcgtggg

SEQ ID NO: 14163 - DNA, 553 bp, Homo sapiens
gaattgaattaaattcagttcatcatctatgcagatttgtttcttttaagcacatccttccctcctgctgttgccctcctcccattaacttttctttttaatcttgaaattggttaaaatattccatctttctttctctagcaaagtgtttgtattccaaataaggcctctgtgaaatgtctgaattacttttcccgtctttgttatggtcagcttcattatttggatgcattgcattcaaagcagcagttccaaacataacacacatctattttcttagagttttgtaaatacaaactaacctgatgacattaaaaattgtggatcctacatgttcctatgttcattctctaaaaacctgagtaactttatgaaaacacacaaacctggaaaaacgtcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttg

SEQ ID NO: 14164 - DNA, 536 bp, Homo sapiens
ggattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatga

SEQ ID NO: 14165 - DNA, 592 bp, Homo sapiens
agggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtcttcacagacttaagggactatgtactactg

SEQ ID NO: 14166 - DNA, 518 bp, Homo sapiens
atccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattca

SEQ ID NO: 14167 - DNA, 609 bp, Homo sapiens
ggtcccgtacgagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcgaaaggagagtcaacatatgtgattgttcataataaa

SEQ ID NO: 14168 - DNA, 425 bp, Homo sapiens
cacatcaatgtagaactcagccttcttggaaagaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggctatcagggaatttttggatggtatctatgtc

SEQ ID NO: 14169 - DNA, 591 bp, Homo sapiens
ggggggtcgcgctgcacagcctgcggcgcaacggaggcggaccgcagtcgagtctgcagagtgttggaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacagtccccattatgacccatctagcaaagaggacaaccctaagtggtcatggtggatgtaca

SEQ ID NO: 14170 - DNA, 608 bp, Homo sapiens
atcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaaatgattttcaataataataatcaaatgaaaaagcttcattcttttcagtgtcttctagatgccctacttaaagagaacattttcttatgtctcatttcaatattttgttaactatgaggatgtgctggtttgttgaatcaaacaaaaggaaatgttgtggaatatttttccaagtagtttgggtcactatcacaggacattggcattatctaca

SEQ ID NO: 14171 - DNA, 186 bp, Homo sapiens
aggccaaggctgggcggatcacgaggtcaggagttcgagaccagcctgccgacatagtgaaattctgtctctactaaaaatacaaaaataataataataatgcaaaaagtaaaacaaacaaaacaaatcaaaatatgttaggaatcccagtcaatggggggaaaggaaacaactaaaaacatatat

SEQ ID NO: 14172 - DNA, 660 bp, Homo sapiens
gctttatttcaaatacaactgcctgtgctatctaaatttggactacagtcttcagtgtacaaatataattcatacttgttcatcagtgtaatcctaacaaatctgttttataggtacagagtgatgaaacatatgggctctggattagaattcgtgaattcaaatcctaactttactactttcttgatatgtgactttggatgaatttgtttcaccctatgccatatcattcttatttataaaataggaataaagataatattgactacctatgaggattaagtagtttaataaaagtaaagcagtgtaattaggatagttgttggcacacaagtatgcaataaatgctagctcattttattattctaatattatgtctatggaaagagtctttagaaaattgtcttgcccaagaacatacagataacaattggcaatgtttgaccttaagctttgttttcctgactctgattcatacctggtaaatttttggaatacacctttgcatttaatgcccttggaaatttaacaaccgggggggggggaaaattccaggaccttttcttccctggctccggaaagaacaccttttacctaagccatcctttccttttttgggccaaaaaaccaagggctttttgggaggaaaaggggggaatt

SEQ ID NO: 14173 - DNA, 202 bp, Homo sapiens
gatatttgaatctggagcaggcttgttcaacccatggcccgcaagccgcatgcagcccaggacgactttgaatgcagcacaacacaaattcataaattttcttaaaacgctatgagaatttttgggtgaactatgtttagctcatcagctattattagcgaagcgtacttatgtctcacccagagcaacttccaaaaaaaaa

SEQ ID NO: 14174 - DNA, 206 bp, Homo sapiens
caggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaacttcaaag

SEQ ID NO: 14175 - DNA, 733 bp, Homo sapiens
  misc_feature 644, 645, 649, 655, 659, 662, 709, 717, 722, 724, 730: n = A,T,C or G
tccctcgggaggaaattgtttggtaatatagaaaggtgtatgctagttgaatttgctgactccagcacagttaaaaggtcaatattcttttgacctgattaatcagtcagaaagtccctataggatagagctggcagctgagaaattttaaaggtaattgataattagtatttgtaactttttaaagggctctttgtatagcagaggatctcatttgactttgttttgatgagggcgatgccctctcttatgtggtacaataccattaaccaaaggtaggtgtccatgcagattttattggcagctgttttattgccattcaactagggaaatgaagaaatcacgcagccttttggttaaatggcagccaaaattttcctcagtgtatttagtgttgtccggtgatgatatcactggttcccaactagatgcttgttggccacggggaaggggaaatgacttgttctaattctaggttcacagaggtatgagaagcctgacctgaagaccattttcaagaaggacgggtttttatgaatcagggtaggctccatatttaaagatagaaccagtttttttttaaattagaacccaaattgtgtaaaattgttaattgggtttttttaaactttgtttatcaaggnncctntttaanttanaanaaagccctggtaaactgttcccttaccctaatttttaaaggcggaancctacccnccccncngggggnagt

SEQ ID NO: 14176 - DNA, 297 bp, Homo sapiens
aatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgcttttttgcttgggataatggagttttctttagaaacagtgccaagaatgacaagatatt

SEQ ID NO: 14177 - DNA, 328 bp, Homo sapiens
ccctaagttttatgaaggaaaatgatttaaaggaattaaattattaatattataaaattaatatttgtcacaatgtatatcattactttatgtttattcactttctctggaattgaattccacatttgaatggaattaaaataagactatcggcttatggttttctggttacagtgccaaatgttgatagaggctggcatgatggcccatgcctgtagtcccaccactttgggaggctcatgcaggtggatcacctgaggtcgggagttccagactagcctggccaacatggtgaaccccatctctaataaaaatacaaaaattagct

SEQ ID NO: 14178 - DNA, 536 bp, Homo sapiens
  misc_feature 536: n = A,T,C or G
aggctatgagagtgggctgccctcattaatgggattgggcccttataagaataggccagagagctttctgctttctaccacatacggatacaagggggaaaaggttatctgcaaaacaggaagagggccctctagaaccaaccgtgctgcaccctgacattggatccttcagcctccaggactctgagaaataagtttctattatttacaccacccagtctatgatactctgttatagtagcctgaactaaaacagtatcttatgccttttctttaaaaaagaaaagaaaatagtggtaggcataccatggaagctgtatagcctagtgcagggagttgatagaccagagaataaatattctaggctttgcaggtaatgcagtcataagcaagttatagaataagttgataatgatacagcttaaagtgctaggaacagaattatcattaaaaaataaaaaaggatttgccccaagtgcttccttgatgaatgacaaaaaaaaaaaaaaaaaattgggcggctggccattgatttn

SEQ ID NO: 14179 - DNA, 600 bp, Homo sapiens
tcaaactggattcacaagaacaggcggggccgaagccgagtttgctctgtgggctggcgctagctgacctctgctgtacatcaacacttggtaatgtcagtgattttgattttagccattctagtaggtgtgtactggtatctctgattttagtttatattttcctgatgactcatgatgttgagcaccttttcatgtgcttactgaccatatctagattttattttgagttgtttattcaaatcatttgcccattaaaaatttatcttactattgaaatgtaagcgttgaattgtaagtgttctttacatgttctagatgtaagtcctttgttaggtaaatggccgtattttgcccagactttggcttgccttttcatcttcttactggtgtctttgaagagcggtttaaattttgatggagtatcagtttttgctactataatcatatttttggggcggttctaagaaatctgcacataaaaagaaaaagtttaataggttttaacttctacttttaaaggcaaggtagtggacctttttttggagccatgggaaattagggtttggggcccaaaggtttttggtttttttggctttc

SEQ ID NO: 14180 - DNA, 253 bp, Homo sapiens
ttctttaataaaatgtgccctgtgtattgcttaaatccatagtccagccttttctgagttcttgagccatgagatggaggtggcctgtgtaatctactatttttagaaagttaggaaagcaaaccaaatactctctgagaggaccctatgaaatggctgtacccttcagctgtctgcttcagactttggccaggctcccaggtgacttacgttaatagcagacttctagttagaagaggagaatttatttcat

SEQ ID NO: 14181 - DNA, 358 bp, Homo sapiens
attaaagtacattatggttatatatgtgcaaattaatgctgtatgctctcaaaggccgagacttttaagtaaaaaattgaggcataccagatgtttaatatggaaaatctgtacagtaagtaagactttttaaagttgaataatctgttgcatttagttcacccctgggttgctgaaaatatttattcaatttcaagttgtttggaagttactggtttctgaattcttaaaaagaaattcagatgtgttaatttataggccacaaagttagattatcactttaatccaagtctttacatctaggcaaacctggcttattaaaactggcttggtagaacatgtgacttgagccaccgaa

SEQ ID NO: 14182 - DNA, 253 bp, Homo sapiens
aaaagaaacaagcatcaagcactcaacaatgcacgcatcaaaacatcttagctgtagcccacacccccacggaaaaacagcagtgattaacctttagcaataaacgaaaggttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaaaa

SEQ ID NO: 14183 - DNA, 234 bp, Homo sapiens
agctcccatggctattcgcggggcagcctggaagtagtgaaatagctgtggggcaaggcatgtcgagcctttcaccttagggaggttgcgatcccagacccacttgaccatctatcacaaatcttgctgaagttctaagatcctatcgactacaaatttcaatgcttccatagaatcatgcctgacctgaggaaaaaattcaaaaatggcacaaacaaaacagaatagtaaaac

SEQ ID NO: 14184 - DNA, 371 bp, Homo sapiens
gactgtaagagaatagggtccaagtgcgtccatattcatagagaagatttatgtcagcatagagtcagacagtcacacccttgtgctcaattgaacctcattgttggtcatcacgaagcaaaatttgtgcattggcaaggaataggcctattgtaaaagggaaaaaacagccgtcccccgtttaaacctggccagtatgggattcttgcgtaacccaaaaattaaattttaaaggcaccaggccgggggtaggccacggtaagcgggaaaaaggccattcctttggttggaaggccaaaatcattccaaattttttggggaagggtggaaccccataaaaagggaataaccttttaaggaaaaatgggggg

SEQ ID NO: 14185 - DNA, 102 bp, Homo sapiens
gagagagaaggcgaacatgcaggacacattgatcatcgacacttcgaacgcacttgcggccccgggttcctcccggggctacgcctgtctgagcgtcgcttg

SEQ ID NO: 14186 - DNA, 309 bp, Homo sapiens
gtttttcttttaaggtttggcttcagtgcacgaatgctttaaataaaatagctctaaggtgttgtcctgaggttagactgatagaaatttgatcaccattttaagtacctcagagggtttctttttttttttaatctcaggtttctcaccttaagagcttgctgaagacattaaatgttctaaaagaagcaatcaaatttagatttactttaaacttaaatttccttctaattttaatctgggatatatcgtggctacatgtcaatagcagacttgactattaaattcagcaattacagtgtattttat

SEQ ID NO: 14187 - DNA, 127 bp, Homo sapiens
tttttaaggttatttctttcagtgcacgaattcctttaataaaaacagctattaaaggagaagcccgtgaggtgtattactggataggaaatagggagcaccatttataagcccctttaaaaggggg

SEQ ID NO: 14188 - DNA, 233 bp, Homo sapiens
gggataggactaatatctttttagggaacacaattcaagccataccaactggcagttgattttagaagttttaaaaggctgggtgcaggccaggcatggtggctcatgcctataatcccagcactctgggagggtgaagtgggaggatcacttgaggccaggggttcaagaccaacctggttaacatagggagaacccatcgtaaaaaaaaaaaaaaaaaaaaaaaaaaaaaa

SEQ ID NO: 14189 - DNA, 427 bp, Homo sapiens
caatgacaaccggaaaggactagaccaaaatattgtgggtgcaataaaaggttggtctgcatcatttcattttgtgggttcttcgttgagctttcccttcattccgtaacgatgcagctgaaattgtagtaaactgactagtggccagtttcatttgccattgccaatttagccattcacatggctttcgggtgtgagctctgtaattcaccaccccaagtaccactagaattcattattcaaggtaatgttaatttgttgaaataataatttaagagccagtttgacctgctgcagaatcaaaaagaagttttttcttgacttttaaaatgcaggtaatttgtaatttctaagagcttcctcagaatatgacttcaacttaaagtttgagttatgagaataaagctatgatgcttcttaaaaaaaa

SEQ ID NO: 14190 - DNA, 562 bp, Homo sapiens
actttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagttaagtctaattgcccattgccataaattttgtcttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctccttaaaa

SEQ ID NO: 14191 - DNA, 523 bp, Homo sapiens
ttgctgtttgtgttcagttttaggatttgctttttcatccaataatcataatactgatttttgagtatatataacatacacagtcatgcaccatatgatgacatttggtcaacaacagaccataatgacctacaggtcctacaggattttaataccatatttttactgtaccttttctatgtttagatacacaaatactgttgtgttacagttggctacgtatacagtacaataacatgctgtataggtttgtagcctaggagcaataggctataccagtagcaataggtgcgtagtaggctataacatctaggtttgtgtaggtacattctgttatatttgcacagtgatgaaattgcctaatggtacatttctcagaacgtttgtccctgtcattatgtgacccataactgtgtgtagctcagaggccaaagttatattaggaggatatgcccagaattctcactaccatcccattttaccttccttgtggataaccatttcatgactactttcaagttta

SEQ ID NO: 14192 - DNA, 280 bp, Homo sapiens
gaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaaaaaaaaaaaaaaaaaaaaaaaaaaa

SEQ ID NO: 14193 - DNA, 384 bp, Homo sapiens
ggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttcagcaagtatccaaccaacttggttctgcttcaataaatctttggaaaactca

SEQ ID NO: 14194 - DNA, 368 bp, Homo sapiens
ctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggtttcctcttctattttgtaaactcaaaatatttgtacatagttatttatttattggagataatctagaacacaggcaaaatccttgcttatgacatcacttgtacaaaataaacaaataacaatgt

SEQ ID NO: 14195 - DNA, 310 bp, Homo sapiens
gaagaggggccaggtatggtggctcatgactctcacctgggcacttagggaggccaaggcaggtggatcacctggggtcaggagttcgagaccagcctggccgacgtggtgaaaccctgtctctactaaaaatacaaaaattagcctggcatggtggcgggcgcctgtagtcccagctactcaggaggctgaggcaggagaatagcttgaacctgagaggtggaggttgcagtgaggcgagatggcaccactgcactgcagcctgggcaacagagtgagactctgtctctaaataaataaataaataaat

SEQ ID NO: 14196 - DNA, 111 bp, Homo sapiens
atacatttggatgttctatcattaatattgtacagtacattttgcgttcacacaattaaatccactgttttcgtagatgtaagataaacccatatgcagttctggatttag

SEQ ID NO: 14197 - DNA, 543 bp, Homo sapiens
ctttggaaacaggttataaacccaaacctctgtgctgaacttgaatgggtgtttcttctctcctttctgagggtaaaagctgctggtgagaacggctctctggtgttgctaggacagacctgtatgaccttctttatgtaaataattaacaggggaatattttcatttacgttaaagccatatatgagagagatttccgggctggctctgacagcctctggccccactggagaaggaagccagcactgaaaaattcaagcttccagtcacacggaacctgagaatattctctatgacagcagtggctgtgaagctgtttctttaaagtaaaacccctttgaaggttagtctggggtgactttactgttacatagggagtagattttgtttcttgatggttcgttgagtggtagagaggttaaaggtagaactaacaaatgtagaactaaaaagcatctgaaacttttagcaaaccagtaatatttagaggcttctgccactctgggtaggcattttatctgtataccatacagctttcacatc

SEQ ID NO: 14198 - DNA, 599 bp, Homo sapiens
ggatatgagtatcctttgcttatctttgtagtactgaaaatttgccgaagtaactggctgtgcagaatgtaatagaagcttttcttattcttttattcttaagatcagtacctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatatttttaattttacacctgaaacaaagaaatgtggtcactaaaaataaaagtatatatgtagggattaatgtactctgcttgtcaagctgtttgctatagtttcaggatatgtactctactctg

SEQ ID NO: 14199 - DNA, 317 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggcgtacaaaaaaaaaaaaaaaaaaaaaaaaaaa

SEQ ID NO: 14200 - DNA, 464 bp, Homo sapiens
ctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaga

SEQ ID NO: 14201 - DNA, 560 bp, Homo sapiens
ggagaacctggagcagggatgaagtaagtaaactataaattttagcatgtggcagaagcagcatattccataagtaagaaaaggaggaaccattcagtgagtagggctggggaaaaagtgattctccttaatgaatgcaatgaaatttcaccatgacatcacatcatatacaaataattatgtcacttagaggttagcgaaaataatactgtaattgttttttctcatttaagttcatgaatatgaatttagttcttaaattcattctctaaatgaatttagttcttaatgcatgaaaaactgtaaaacttttacttaaaaaatacagacaaatatctttcaatattgtactagggagtgatttcttaagagaaacacaaacttttggccttagaaaattgagacatttgagtatattaaaattaaggactttttctttattaaaaaataaagaaggtagaaatacaagttacaaacttttgcaaaacatacagcctatgaaggattagtatacagtatatataaaaaactcctccaatcaattaaaaaacacaatagaa

SEQ ID NO: 14202 - DNA, 465 bp, Homo sapiens
gaacacaacaaaaaaagaaaactacaggccaatatccctggtgcatacaactggaaaaagcctcaatgcaataccaacaaatcccatccaacagcatatcaagaagataactgatcactatccagtgggttttaacccggggatgcaaaaatggttcaacacacacagaccttacacatgacaatatatcatagacttaaatttaaaatggaccactataaaacttttagaactgataaataagtttagtaaagtttcaggatacaaaatcaatgcaaagaatcagtagcatttctatataccaataacattcaaactgagagccaaatcaagaacacaatcctatttacaatagccacacagaaaaatgaaatacctaagaaaacagctaaccaagaagatgaaagtgctctacaaggagaattataaaacactgctgaaagaaatcagagatgacacaatcaa

SEQ ID NO: 14203 - DNA, 223 bp, Homo sapiens
caagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcaccaatttttcggactttttaaatcattagcattattatttttaattaaaaaaatgcc

SEQ ID NO: 14204 - DNA, 598 bp, Homo sapiens
gaggcattgaggcaccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacacgacggaggttgagatgaagcttcttcatggagtaaaaaatgtatttaaaagaaaattgagagaaaggactacagagccccgaattaataccaatagaagggcaatgcttttagattaaaatgaagatgacttaaacagcttaaagtttagtttaaaagttgtaggtgattaaaataatttgaaggcgaagaaaagaatagagaagatagggaaattagaagataaaaacatacttttagaagaaaaaagataaatttaaacctgaaaagtaggaagcagaagaaaaaagacagctaggaacaaaaagctaagggcaaaatgtacaaacttagaagaaaattggg

SEQ ID NO: 14205 - DNA, 539 bp, Homo sapiens
aggggaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacc

SEQ ID NO: 14206 - DNA, 284 bp, Homo sapiens
gttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaaaaaaaaaaaaaaaaaaaaaaaaa

SEQ ID NO: 14207 - DNA, 477 bp, Homo sapiens
cagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcatttaaatataattatgttttaagtatactgaatttctg

SEQ ID NO: 14208 - DNA, 575 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcattactaaacgcagacgaaaatgggaagattaattgggagt

SEQ ID NO: 14209 - DNA, 634 bp, Homo sapiens
tatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagcaagtgctaacatgccttgggtcaagggatgggaagtcacccgta

SEQ ID NO: 14210 - DNA, 527 bp, Homo sapiens
aagaaatttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttgggtatttgttttattaaaacatgtacatcagtaaagagtttaaac

SEQ ID NO: 14211 - DNA, 427 bp, Homo sapiens
gaaggttaatcttgtagttcactgtaatacttaccttaaagcaaaatgaattacagtgtgcaggctaagtgctggaatgttaatatttgttcatttattatactatattcaaaaataaaatgtcatttatatttgagacagtgacatataaacaaaaatgtaactcttttcgtttttcagaattatggctaaatagagaaaataattgatctatggtgggtcccaggcaagttgactctgatttagagcaagatcctattgaggccaaggtcatgggtaaatttcttaagagggccagttaatttggttctggaacatagcaagaagttgtactcctgacctcagcttgccaactcacttcatggttgcaaaaggatagaagatggatgattcagtttaaaaaaaaaaaaaaaaaaaaaaaaaaaaa

SEQ ID NO: 14212 - DNA, 565 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccggaaggtgattaaaagaccttgaaatccatgacgcagggagaattgcgtcattaaagcctagttaacgcattactaaacgcagacgaaaatgggaagatt

SEQ ID NO: 14213 - DNA, 551 bp, Homo sapiens
gaactcttcctacgtgatgagttaattccaaacagcgctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagactgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaagtcttgaac

SEQ ID NO: 14214 - DNA, 574 bp, Homo sapiens
gaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaagataacttaaacgagtcagtaataactgaagagaaagaaacagatggagatcacctatcttcattactgaacaaaactacggttcacaatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaagggtattaaag

SEQ ID NO: 14215 - DNA, 471 bp, Homo sapiens
gctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaataaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgt

SEQ ID NO: 14216 - DNA, 242 bp, Homo sapiens
catgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaaaaaaaaaaaaaaaaaaaaaaaaaaaaaaaaaaaaaaaaaaaaaaaaaa

SEQ ID NO: 14217 - DNA, 572 bp, Homo sapiens
catttctcttggaatgtgtattgtttttattttgcgaaacaaaacaaaacaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtaaaa

SEQ ID NO: 14218 - DNA, 589 bp, Homo sapiens
gatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacgctgtgttatattctttgaatcctagcccatctgcagagcaatgactgtgctcaccagtaaaagataacctttctttctgaaatagtcaaatacgaaattagaaaagccctccctattttaactacctcaactgggtcagaaacacagattgtattctatgagtccagaagatgaaaaaaattttatacgttgataaaacttataaatttcattgattaatctcctggg

SEQ ID NO: 14219 - DNA, 412 bp, Homo sapiens
atctttagcttcctttaagaaaacaacttatgatttcaaatttacattgttctaaagtctcccaattttcatccaactcctccctttgaaagaaaaccagctttatcttcaagatgaaatctaaaccccaccagagtcaacagtactgttttctgtttgtaattttttacctcaaattgattcagaaatgtaatggaagttccaacatagtcttaaaggtagaaggaatggggaagacatgtctacataattctaaatttctggacaaagaaggacttaaagataattaacacactttggaaaataaaagcaataataaatttctaataccagatattgaatattttattaagcagcaattatcaatactgtagaaatgctgcacagttaaaaaaaaaaaaaaaaaaaaaaa

SEQ ID NO: 14220 - DNA, 521 bp, Homo sapiens
agggcttagctcttgaaaactagaatgtatattacttcctttgttataagtaaagggggtattctgaatgtttgaagtagagagctgggaagttgaagttatccacgtttaatggttccctgctttctaggaagtagggatattataaaatgagaaagatggggtttgggggagaggggtttgaagagggataaagaagatgtggcatgattcctttagaaaacaatcatgatcaagtcaactagagatgaatgaaataatttcccagggttgcatgaattatgatagatttatttgggttaggttcgtgatttagtatagcagtctcagaagagtccacataaaatggattatatcatatacctaggatggagactgataagatgtgtataatgaaagaaaaagtggattagaaaaatatagaatgatcaggggattccatagaatgagacaagtggaagggaccttttcaactgagaaaatttgggagaggaatgaaggacctagaagtggttaggtat

SEQ ID NO: 14221 - DNA, 237 bp, Homo sapiens
cccacattaggcttaaatacagatgcaattcccggacgtctaaaccaaacggactttcaccgctacacgaccgggggtatactacggtcaatgctctgaaatctgtggagcaaaccacagtttcatacccatcgtcctagaattaattcccctaaaaatctttgaaatagggcccgtatttaccctatagcaccccctctaccccctctagagccaaaaaaaaaaaaaaaaaaaaaa

SEQ ID NO: 14222 - DNA, 660 bp, Homo sapiens
ccagatatacatgccacaattacttcgttcatttatgggtggatatttagagcatttctggctagaggtctggagctaatacaaataaagcagttatgaacatttgtgtacaagcctttgtaaggaaaaatgcttttatttctcttgggtaattacctaagaatggaatgactggatcatatggtagatggttgtttaacttttaacaacagccatgttgttttccaaagtagttgtgccattttacattccaaccagcagtacaattttcttttcttgtaatgttcttgctcgttgggtatcagagtattgcaggcctcatagaattgggaagagtactccctcctcttcaattttctgaagagtttatatagaattggtattattttatgtaagtattctatacaattcaacagttaagctttgagcctgaagttttctttgtaggaaggattatttagaaatatattccatttccaaatatttgggaattatccagattttttgttgctattgacttctaacttaatttccattggtggtcaggagaacatatttctgtatttttcccaggccttcaaaattcaattgaggataaggttttatgaccctacccttatgggcctctttctggctgggggttcatggcccccttggccc

SEQ ID NO: 14223 - DNA, 640 bp, Homo sapiens
atttcatcttgggaagagcttcaatcctccggtgcaggagaatatggacgtgagtaagtatctcggaagatggtacgaaattgagaagatcccaacaacctttgagaatggcgctgcatccaggccaactactcactaatggaaaacggggagatcaaagcgttaaaccaggagttgagagctgatggaactgtgaatcaaatcgaaggtgaagccaccccagttaacctcacagagcctgcaagctggaagttaagttttcctggtttatgccatccggccccgtactggatcctggccaccgactatgagaactatgccctcgtgtattcctgtacctgcatcatccaactttttcacgtggattttgcttggatcttggcaagaaaccctaatctccctccagaaacagtggctctctaaaaaatatcctgacttctaataacattgatgtcaaagaaaatgacggtcacagaccaggtgaactgccccaagctctcgtaccaggttctacagggaggcttgcacccactccatgttacttttgcttcggtttcccctaccccaccccccccttaaagacaaacccattcaaccatgacaaagggaaggttgacctgaacatgtaaccattgcccct

SEQ ID NO: 14224 - DNA, 700 bp, Homo sapiens
ttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgaggtgaagcttcttcatggagtaaaaaatgtatttaaaagaaaattgagagaaaggctacagagccccgaattaataccaatagaaggcaatgcttttagattaaaatgaaggtgcttaaacagcttaaagtttagtttaaaagttgtaggtgattaaaataatttgaaggcgatcttttaaaaagagattaaaccgaaggtggattaaaaagaccttgaaatccatgacgcagggaggaattggcgtcattttaaaggcctaagtttaaccgcattttacctaaaccgccagaccggaaaaaatgggaaaaggaattaaaattgggggaaggggggttaggggaatggaaaaccaaatttttggggaggaaaggaaatgggaaaggtttttggaaagggggggaaaaaaccttgggaaaagaacaggaaatttcccggg

SEQ ID NO: 14225 - DNA, 331 bp, Homo sapiens
aaaagcacaaagacagatgtatagctttatgctaattttatttcaatatgatagaaaatgtatcttgtgtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaagccca

SEQ ID NO: 14226 - DNA, 624 bp, Homo sapiens
catatgctgtctacaggaatacactttaaatgtaataacatggatatcttgagagtgaaaagatagaaagatatatacaatgcaaacaataagcatgagaaagctaggttggaatattaatattacaaagaatagactttatgccaaggagtactattagagataaggagggatatttcctaatcatatgtgtgaaattatcatgaatgcataagtcataaacatgtagacacaaactgacagaaaactagagagaaatagtaaaatctacaataacaattggagatattaacattcttgttctagaacttgatagaacaaataggcagaaaatcagtaagaatacacaagaaattaaaaacaccatcaactgccttgcctgtttgatgtttacagaacactattcccacttggagaatgtgtctattcccacctggagaatatgtgttctttaaaacatatttaaaacatacaggaatagagcctgtatggatggtctactttatttattaaagtagaccctaatctggtcatcaaatgagttcaaacattttcaaaagatgagatactacaaaaatgcctctggttataattaattaaattagaaaaccaaaaaaaaaaaaa

SEQ ID NO: 14227 - DNA, 610 bp, Homo sapiens
atgtgtattatccattctcaccaatctagaggtagtcatgagtttggtggatcggaattactgcttaataatggtaatcccctttaagtatttactggttgaaataattaaagtttttctggtagattcttaaccataaaaacgaagcgaactgcttattctgccccatccacaggtatgcagcctcttcatgcttgcccctgcctggaatgcccatgcccggaatgtcacatgtttggctaggaatgcatttaggtcagagcttacaggtcacttcctgcccttgatctgcttttctaaaaaaactgtttcccatttttctttttttttcccatttttcatttttctttctttcatgcatgctgctttatttttgctgccgtatcattagccaacattgtactgtcttctatctggaacataaattccatcaagatagggactatgttggttattgctccatctccagggcctgaatataggaaggaactcaataaatacttggtggaggaaaagtatttgctatatccctgtccccttcaggtttaaatggatccctaaaaataatggccggaaattgagcttacctttggaaaggaatggaaaacca

SEQ ID NO: 14228 - DNA, 474 bp, Homo sapiens
cttattggatcaaaaattgtgtcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattgggttgaatgcctatgtatgtcaggccctgtgctgagccatgagggattaaaaagatgaataaacatatcttggtttaaggaaatgggatgtataaaaaaaacaagtgcaataaaagtgtggtgttccaaaagccggg

SEQ ID NO: 14229 - DNA, 580 bp, Homo sapiens
tgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttatcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagttaagtaattgcctacaataaaaagaaatttgcctg

SEQ ID NO: 14230 - DNA, 301 bp, Homo sapiens
gtgaacacaccgataaagcaatcaaagctgctgcgttgaaaaaaaaaaacaaaacacaacacctccctcgagggtttggggggataccgtgtcagcctgcatagaagggtttgcagtgaaatgcagcatttccaaaaccagggattaggccatgacgtgagaacgacacgttaatctgagcgccaccccagggggggcattgacattgaaatgagccgggtttgtgtcctgtatgggaattgaaggccactgctttccccttgtaaatatgtgcaaattgcagagatctgaatcaaggcgc

SEQ ID NO: 14231 - DNA, 581 bp, Homo sapiens
gtgaaaaaagcactataagaaaatgcatcatcagtttgctatttccctgatggccttaattttagagtggtcttggattactaaagataaagacaaagcacattttctagaatgaactcacagagatgtgctggcttagactccaaaaggattataaaactcccaaagtaccagttttccagaaaaccacattttacagtttatgatgattaatagcagcagcatgttcagtttcgcttatatgagaaacatgtttaggcaactagtcagaaaaccagctatggccttacagaaagggaaaagtttaacccattattaaaaagtgtgtgtgggaggggggctggtttacaatattaaaccatttaaagtattttattctacaaatggggtttgttttcttgtcatgcataatcagattatgtcccctcccttctggtaaacatggtttaaggaacgctgctgtttggtttgtgattgattagaaactatacattaacttacacagtgctatcaattaaagattgtacaggttccagatgattaataaggtcaaagttcatggaatggcacgccagcattgg

SEQ ID NO: 14232 - DNA, 527 bp, Homo sapiens
aactgaaggatcccctaacctaacaaagttttagaacaattggtctagatttcaaaaagcaagacagccggaacatgtggaaataattcaagacctgggttcattgtagctcgcatttccaaacaaagttcttttcaatttctagggaaaacataaaaaaatggagcctcaaaactttccaagagcccagtggaagtgataaaaattcaaagcaaaaagtccaaatgttagtataaaaagattctagaaagcacggggatacttgtaagagtagagttggactctgtgttcccacccatactctaaccaaaaagagtcctaaaaaaaaagaatagcttgacaaagttaaaaagaaatttgagttctctccattacagctgctatgcaaaccaatagacctgcagagtaactgtcttagcaattcagtaactccaaagtttaatatagatggtagttgctttcaacaactgcagatataaattgtgtgtgatggtacacacaatagtcccagatactcaggaggctga

SEQ ID NO: 14233 - DNA, 526 bp, Homo sapiens
ataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccactcactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttagactgtattaataaacatacaacacaagctgggccttgtgttgctgggttcctattcagtatttcctggggattgtttgctttttaagtaaaacacttctgacccatagctcagtatgtctgaattccagaggtcacatcagcatcttctgcttgaaaactctcacagctgtggctgc

SEQ ID NO: 14234 - DNA, 515 bp, Homo sapiens
gcccggaagttgatgcccagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggctgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctctatttggtgtcagtttttcaataaagtttttga

SEQ ID NO: 14235 - DNA, 372 bp, Homo sapiens
acgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatcca

SEQ ID NO: 14236 - DNA, 315 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagatttcaagagaaaatatgaagacttagaagagtagcatgaggaaggaaaagataaaaggtttctaaaacatgacggaggttgagatgaagcttcttcatggggtaaaaaaaaaaaaaaaaaaaaaaaaaaa

SEQ ID NO: 14237 - DNA, 225 bp, Homo sapiens
attgatggaaaaacaaagtcagaggactgacaccccccaacttgaagactctaaagctacaataacagtgcgatattgtcaaaagaatagacaaatagaatagagagccccaaaatagacccacacaaatatagttaactgagttaactgatatgacagaggagcaaaagcaactcagtggagaaagcgtagtcttcaacagatggtactggaacaactgccatc

SEQ ID NO: 14238 - DNA, 281 bp, Homo sapiens
cgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttca

SEQ ID NO: 14239 - DNA, 557 bp, Homo sapiens
ggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtaccatgaggaaggaaaagataaaaggtttctaaaacatgacggaggttgagatgaagcttcttcatggagtaaaaatgtatttaaaagaaaattgagagaaaggactacagagccccgaattaataccaatagaagggcaatgctttagattaaaatgaaggtgacttaaacagcttaaagtttagtttaaaagttgtaggtgattaaaataatttgaaggcgatcttttaaaaagagattaaaccgaagtgattaaaagaccttgaaatccatgacgcagggagaattgcgtcatttaaagcctagttaacgcattactaaacgcagacgaaaatggg

SEQ ID NO: 14240 - DNA, 409 bp, Homo sapiens
gaaaaactaatactcaaaacagttaaaatattcatttttatagaggaggttatagagaggcagttagggaagggggattacctgaaggaaaacaatgatttggaattggcaaaacctgtctgggtctctctagcaaacaataggtctttcttaggttgctgttaaaaaaactaattatgtgacagtgatcacatctctagatgcaaaggatctttaggttatacaagaatagcattaatcattgttacttttgttttttatatatttttttctttcttttttttgtagtggtaagaggttttattttcttctcatcccaggaataggtttgcatactgctaagttgcagtgagctgagatcatgccactgcactccatccagggtgacagagcaagactccatctcaaa

SEQ ID NO: 14241 - DNA, 594 bp, Homo sapiens
caatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttacagagtgtcaatgttatcattgattatagaagacagggataatacctttatctctggccgctcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccacacacacactgcagcattgaccaagacca

SEQ ID NO: 14242 - DNA, 400 bp, Homo sapiens
cgactagtactatgcctcatgcgctgtgtgctctttgaaaggaatgacagcagactacaaagcaaataagatatactgagcctcaacagattgccttctcctcagagtctctcctatttttgttacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaaggtt

SEQ ID NO: 14243 - DNA, 554 bp, Homo sapiens
ccagtgcttaagcttgcatctggctgatatcgaatgatgcgagccgtccaacactaggacttttccccccataagccagggggggggaattactaatacatgggttaaagaaggtagattttgttttcaatatttggggaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttattctaagagcaagttgagttgaactgaatcttccttgcttagtaacaatgtataaatagtggcttttctggcaaaaggctgtaatgcctcctgatggatataattttgggattgtatttaaaagtgaataaatcacaccagctcctgaaaatgttcataatgcatcttttggaaaacaaatacatgcctactttgtgcatatttgcattaacatggcaaagattgtatgaaatacctgtttttcaagaaaataaagggtttc

SEQ ID NO: 14244 - DNA, 620 bp, Homo sapiens
atctctgtgggcatgtgtatgtacaaaataaatctgtgaattccagtagagccagtatccaggactctaaaaggggaacagactgatttatttgtgacaatgtacttcagctgaacctctgtgctagtttgttggcaaaacctaacatatggccttttaatgagagacagattaataattgcagatatgaataataaagcagaaagattggctgtgccatcttttattctaataaggaattagatttggttactgaaggagcagctgtttgccaggtatggtatgctactgtttgagatagacactttgatgcaaaatgggacgcttgatggcgatggacttgaaaaaatggatatgccgatgtgtgtttaaatttctcaagccctataacaataaacattttacaccccaattgattattattctataccaattgtcattcaaaaacctacaaaaaagacacaggggacaatggttttcctgtctggtggtctttggagaaaaaagacctattattggtaccctaagtgcaattggaaaaaaaaacctcttggacaaaagggttcaaattagaagtggtggccaagtttctggaattttttgacattaatgtttaaaaa

SEQ ID NO: 14245 - DNA, 645 bp, Homo sapiens
  misc_feature 645: n = A,T,C or G
agtgactcggactcggcaaaggaatgacatctcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactgggtcaaggtttgtagtaccaagtgcttctgccaaagcaggtgtggaaaccatgagcaagtctcttgcagctgaatgggggtaaatatggaatgcgattcaatgtgattcaaccagggcctttaaaaaccaaaggtgccttttagccgtttggaccccaactggacatttgagaaagaaaatgattggcagaattccctgtgggcgcctggggacttgagaaaaaccgcaaatctgcn

SEQ ID NO: 14246 - DNA, 236 bp, Homo sapiens
gtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaaaaaaaaaaaaaaaaaaaaaaaa

SEQ ID NO: 14247 - DNA, 526 bp, Homo sapiens
gaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttca

SEQ ID NO: 14248 - DNA, 540 bp, Homo sapiens
gacaagccgctaatgttttgaaatgatatgaccaaaattttaagtaggaaagtcacccaaacacttctgctcacacttaagcggctggcccgcactactgagcggaacacgcatgatcttagttactgtaatatttgaaatatccacagcactcacttttcccaagcgatgctagcagttgcctagaaatatgttactcttacgtgtgattcatcaaattttccgagaatttgtatacggaaaaaattggatggaaaacacttagcatgcagtcgataagaggagtttggtataatgtatggtgggtggatatttctcatactgtatggtgccaagagctttactactgaggcaagacagcttgttttaatacaggatttactttccctaggtagaaatgtggaaagaaaccaacattttgctgggtcagggacatggtttagatctgtgggtccaccaaatctcatgggggaatgtagggcccagtgctggaggtgcggcatggtggggggggacccaaccatggggggcggggttttg

SEQ ID NO: 14249 - DNA, 400 bp, Homo sapiens
atttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgactaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatg

SEQ ID NO: 14250 - DNA, 152 bp, Homo sapiens
attgtgcatcagtttcattaactcttccccgatccccaaaattttgaatttttttttcaacactcttacacctgttaaggaaaatgtcaacctttgttaggtaacccaaaataaaatttgagaaataaaagccataaccatttgcaccaaaa

SEQ ID NO: 14251 - DNA, 228 bp, Homo sapiens
ggctgttcgcagagctgcggaagatgaatgccagaggactcggatctgagctaaaggacagtattccagttactgaactttcagcaagtggaccttttgaaagtcatgatcttcttcggaaaggtttttcttttttgaaaaatgaacttttgtcctagtcatccccttgaattatcagagaaaatttttccagctctaaccaagattaaattggcttttttccccacw

SEQ ID NO: 14252 - DNA, 200 bp, Homo sapiens
gctccagtgctacgtgtccctggcattttaggtgtcggttgggtaggcagtcatggatcaggtaatgcagtttgttgagccaagtcggcagtttgttaaaggactccattcggctggttaaaagatgcactaaacctgatagaaaagaattccagaagatttccatggcaacagcaatatgggttttctatatatggggk

SEQ ID NO: 14253 - DNA, 123 bp, Homo sapiens
gaagacacaagtacgggaaggcgaagaaaagaatagagaagatagggaaattagaagataaaaacatacttttagaagaaaaaagataaatttaaacctgaaaagtaggaagcacaagaaaaa

SEQ ID NO: 14254 - DNA, 668 bp, Homo sapiens
atgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattttctgtaagctttcccacaaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcattagatataaaaatatatgaagtatgcttgtgattatagtgagaaccatgacatagttaaccaaagatatgtttgg

SEQ ID NO: 14255 - DNA, 552 bp, Homo sapiens
atcctttttttgggtaattatatagaacttgtaatattcaaatgtatgtagactctagttattccatgacaaaagtctttacttgattgatttcattattgaggattggcagagaccacaagctcatctattcctttgttatcttgccagtctattaaaattattaactcaaaagcatacaggttttgaagggaagaataatgttttttcatgtaagactggcttatgcttacttaaacaaaaatcacattaaaacccatttcttcccataaaggaagaactaagacttgatttttttttctaattaggaggaaaattatttcaatttaactaactttctatataaagtaactgaaagtgtgctagactacgttgtgatttgtgttattttgaagatgtcattttaataagaaaatctgaaaacataaactgtgagaccagtcacaggcaagaacatggaaatacattgtacaaatctgttttgatagtgcataaaactgtagttaagtaatttatttagctacttaaaagatagaattggtaaatgagtaa

SEQ ID NO: 14256 - DNA, 350 bp, Homo sapiens
aagatagcacgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcaccagactctgagtatctggttgctgtgtcataacttcatagatgcaggaggctcaggtgatctgtttgaggagagcaccctaggcagcctgcagggaataacatactggccgttctgacctgttgccagcagatacacaggacatggatgaaatcctgg

SEQ ID NO: 14257 - DNA, 171 bp, Homo sapiens
ctcggtggtggccactgcgcagaccagacttcgctcgtactcgtgcgcctcgcttcgcttttcctccgcaaccatgtttgacaaacccgatatggctgagatcgagaaattcgataagtcgaaactgaaggagacaaaaacggaagagaaaaaatcccctgccctcccaaa

SEQ ID NO: 14258 - DNA, 229 bp, Homo sapiens
tgatccaataacttgaccaacggaacaagttaccctagggataacagcgcaatcctattctagagtccatatcaacaatagggtttacgacctcgatgttggatcaggacatcccgatggtgcagccgctattaaaggttcggttgttcaacggttaaagtcccacgggtatctgagagtcagagcccgagtatatccacaggcggggttctatctactctcaaaaaty

SEQ ID NO: 14259 - DNA, 217 bp, Homo sapiens
gtgggtttaggtaattgtttagtttatgattgcagataaactcatgccagagaacttaaagtcttagaatggaaaaagtaaagaaatatcaacttccaagttggcaagtaactcccaatgatttaggttttttccccccagtttgaattgggaagcttggggaaggtaaatatatagaccactctgggtgttaccacattcatataattttgggcaa

SEQ ID NO: 14260 - DNA, 190 bp, Homo sapiens
tacatggatcaggccagtggaaatgtaaagaaggccctgaagctgatggggtcaaatgaaggtgaattcaaggctgaaggaaatagcaaattcacctacacagttcttgaggatggttgcacgaaacacacttgggaatggagcaaaacagtctttgaatatcgacacagcaaggctgtgagagctaccy

SEQ ID NO: 14261 - DNA, 199 bp, Homo sapiens
gaataaagcactgtccttgcagatgaaaaaagtctccagagcagacttctgacaggaaaggtttagatgctggagagttgaagaggtgtaagaagagatcgtgccctcatttttcacttattttttttggttattcatttataataaaagggtggcatttatattggacaacttcaaattacttgcaggtcttaggtca

SEQ ID NO: 14262 - DNA, 181 bp, Homo sapiens
tcaaatataagatcgacatttaaaccagtaatcgatggatccatgcttaaaaatgacataaaacaaagattagcaagagagcgcagagaggagaaaaggagacaacaagacgccaataaagaaacacaactacttgaaaaagaaagaaagaccaagctcccatattaaaaaccggtgggag

SEQ ID NO: 14263 - DNA, 169 bp, Homo sapiens
gtttcacctagtatgcctgcaataagtgttagagcaggagtggtgccatccactattatggagacactttcctattagtctattcatgaggtggtgcaaagcaggtcgttacttaccagccagctctattcagagtccacctttcttttggataaaagtcccaaactct

SEQ ID NO: 14264 - DNA, 179 bp, Homo sapiens
tacccgtcagtattttttaattagcagatggtgtatgccgaacagctgtgattcagagacagaagaattttatatatgtgaaatgtaaatcaggtcttaattattcagaggatgattgaggcacacatttcttctttgagcgcatactcgggggttcatgggttctgccgcacacaaat

SEQ ID NO: 14265 - DNA, 163 bp, Homo sapiens
ggagtacttctccatgcttctagtcggaaaagacggaaatgtcaaatccttggtatccttccccaatgtggtccatggtgattgtgtacgatttaattgattcgatgcaacttcggggacaggaaattgcggattcagcagtcactcggggatgcgctgcccm

SEQ ID NO: 14266 - DNA, 166 bp, Homo sapiens
tgttaagacctagtgtttagattagttgagaaattttccccatatagtagtttattatatgtttagtgtgtatggtttataaaatttaatttgggtattagtttagagatatttaatatatataaccccccccgtgtaatggttgtaaggatttaaataatatggg

SEQ ID NO: 14267 - DNA, 159 bp, Homo sapiens
ctatttgatgaatgaggtaatacactgccttctcagactaaacttctgttagattcggtgcctttttttacagatgagattgtaaagtgagcctctaagtggatttacggctcacttgtgatttgcttaaaacatgtgtcaccatggggaggggggatg

SEQ ID NO: 14268 - DNA, 104 bp, Homo sapiens
cagcatatttcatctgtactcaatattcacttttaaaggaaggtatattttggttatgttgtcataatcaccaatttactgttttaaagaaatagaaggtccat

SEQ ID NO: 14269 - DNA, 172 bp, Homo sapiens
gcaagagaaaaatccactgccttccaaagaaacgattaacaggagaagcaagcaggcgaatcgtaatgaggcgtgcgccgccaatatgcactgtacattccacaagcattgccgtcttattttacttcttttagstgtttaactttgtaagatgcaaaggggatgggtcaag

SEQ ID NO: 14270 - DNA, 176 bp, Homo sapiens
tgtgtaatttaggtaaactgcagtgtttaacataataatgttttaaaggcttagttgtcagtattaaataatcctggcattatagggcaaaaacctccctagcagttagattatttgctactgtgagaatattgtcaccactgggaggtactttaggtcaattaattttcaatttt

SEQ ID NO: 14271 - DNA, 141 bp, Homo sapiens
acgaggcaggagtctagacagccctaccaacaaggggaaacccggctctatcataaaaacaaaaaaaaattaggcaagggggcaagtcacccgtaagcccagccaccttggaggccgttgcaggagaaaggtcggtaaccc

SEQ ID NO: 14272 - DNA, 315 bp, Homo sapiens
acaagatggatggtcgccagcagtaccatgcctcagcaaatgttattttccttatttggaaaatggatatagtcaaaattatggaagaaagtttgtacagggtaaatctatagacgttgcctgccatcctggctacgctcttccaaaagcgcagaccacagttacatgtatggagaatggctggtctcctactccagatgcatccgtgtcaaaacatgttccaaatcaagtatagatattgagaatgggtttatttcagaatctcagtatacatatgccttaaaagaaaaagcaaaatatcaatgcatactaggg

SEQ ID NO: 14273 - DNA, 304 bp, Homo sapiens
tttttcgtcgagtaagtgtagaacgatggagagagttacccatgattggtttggaaggagttaaggaacagtaatgccttttaaagtgatttatgatgatgtgtggagtttaaaaactttaccccaccccaaagaaaaggccttctaactcctaactgaggtcccctctgaacgtgctaaaattgggaaggagggcggtgttttgctgatctgttaaattcttagtgaagtttccttgatttccagtggctgctgttgtttgagtttggtttggagcaaaactgaggtagtcctaacatttctg

SEQ ID NO: 14274 - DNA, 316 bp, Homo sapiens
aagtcgcaccacggagagcacgagagacccgagttcatcgcctacccccatctccgcatcaggaccaagccgtttcccttggggagatggtaaccatactctattccataaccctcatgtgaatccacttccaactggctacgaggatgaataaagagaatctggaccactacccgggcaccagggaccacagcactggtttggaccgcttactctgcacatggaccagaaaaagtatataggaccttaagctcaccttctttacttgtatcaaatgatgactggtatactggtctcccatccctctgcttgtggc

SEQ ID NO: 14275 - DNA, 314 bp, Homo sapiens
tgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtagttctcagtgttggctgtatacactttgtagtcactttggaatgttggaagacacatcgatgcttgggttccgtatgccaagattctgatgttggtctggaatatgagctggacataaggatttttaaaactttcttggca

SEQ ID NO: 14276 - DNA, 319 bp, Homo sapiens
ttgaggcagccagcgcaggggcttctgctgagggggcaggcggagtttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaaggacttagaagagttagcattgaggacggaaaagataaaaggtttctaaaacatggacggaggtagaggatgaaggctctttcatggagtaaaaaacgttattcaccaggaatttgagagg

SEQ ID NO: 14277 - DNA, 302 bp, Homo sapiens
tcttttcatatgctataatggatcatgttacttggtaatgaataatattgaattacatgaataaaaaacaccaatacaaaatatactcaaaataccaatacaaaatatactcaaaaataactgataaaatgcattgggcatcttttttttctatttcagtatattctacatcctgaccaccaacagaagttaatggttaataaatatttaagtaagatagagttataaagtccatcttcacttatatttctggtgaaaagacattaaatagtggaaatggatgatatcttgtaaccatgact

SEQ ID NO: 14278 - DNA, 284 bp, Homo sapiens
aagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagacttttgcgaacgctacgacatggtttatggatacaatgctgcctataatctgctacttcaggaagcgccgaggggcccacaatgagactgagggtaggaataagattctctcttctttctggag

SEQ ID NO: 14279 - DNA, 324 bp, Homo sapiens
gttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtcggggtgtcctgactactgtaggatctgggacttggcaaatgtttgtgtgcgcctccttaaactagctgttattttatgattatagttcttgtaagattaattaggaaaaagaggattttcgtcgaaggtgaagtagaagaagaaggagaaaggagaaagtcgatcgtcgcccgct

SEQ ID NO: 14280 - DNA, 160 bp, Homo sapiens
agaacgacacaggttaggagacgtcgctttgaacgtgctataggaccttctcaaacacacaccatcagatttcattattcacctgccagactggcttatcaggccaacggtgtccttcatattgaggttaaggtgagtatcctgtggagaggcattccaa

SEQ ID NO: 14281 - DNA, 209 bp, Homo sapiens
tcagcactttaggaggctgaggtggaaggatcacttgcaggccagagttttgagtaccagtcctttgccaccagcagtcaggtaggccagttcttcttcgcaaaaacctttaaaaaaatatagtcgtggctgttggtgtttgctccactccatcagtttcgcgagctcactcgtgtgtaggtcttgtgagtgtcgagtttagagtaatc

SEQ ID NO: 14282 - DNA, 243 bp, Homo sapiens
gatgttctccgacatctacaagatccgggagatcgcggacggggttgtgcctggaggtggaggggaagatggtcagtaggacaggaggtaacattgatgactcgctcattggtggaaatgcctcccctgaaggcccccagggcgaaggtaccgaaagcacagtaatcactcggtgtcgatattgtcatgaaccatcacctgcaggaaacaagtttcacaaagggagcctacaggaggtacatc

SEQ ID NO: 14283 - DNA, 187 bp, Homo sapiens
aggaaggacgttggtgttgaggttagcatacgtatcaaggacggtaactaccatggctcccgaagttttgccaaaacctcggatgcgtggccttctggccaggcgtctgcgaaatcatatggctgtagcattcgtgctatccctgggggttgcagctttgtataagattcgggtggctgatcaaaga

SEQ ID NO: 14284 - DNA, 241 bp, Homo sapiens
cggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacatttc

SEQ ID NO: 14285 - DNA, 244 bp, Homo sapiens
ctgaagctgacagcattcgggccgagatgtctcgctccgtggccttagctgtgctcgcgctactctctctttctggcctggaggctatccagcgtactccaaagattcaggcttactcacgtcatccagcagagaatggaaagtcaaatttcctgaattgctacgtgtctgtggtttcatccatccgacattgaagtgtgacttactgaaagaatggagagagaattgaaaaagtggagcattc

SEQ ID NO: 14286 - DNA, 240 bp, Homo sapiens
gtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctc

SEQ ID NO: 14287 - DNA, 239 bp, Homo sapiens
gtctgttgtgttttatgcagactttcctgaaaatagtgtttaaaggtattagccatagtgtatttcttggagataaattaaactttctatagttctgtttctctaaaatttgtttttctctttaccttatagtcccgcagtattgatgaggagaccattaagacttaatatttttttgacacaatcttatatctctttctccaacccctaaaaaagtgactgaggataggtacattcaa

SEQ ID NO: 14288 - DNA, 291 bp, Homo sapiens
tgaacaacagatattgctctatatttttgtattagtatggtttgagacaacatatggagaatgttcacatttgtagagttaagctggaattattattgagagcaataagcacacatttatttttgcttaacacagtgttatagctgggtcctagagatttgaggctttataactcaatatgtttataaaacatagaggctgctcgtactacagatgtcactcatttgtatattgcagacagaccaaagtggcactgaaattttcttgctcacctgttaaacacttgttcct

SEQ ID NO: 14289 - DNA, 318 bp, Homo sapiens
cctgaagctgacagcattcgggccgagatgtctcgctccgtggccttagctgtgctcgcgctactctctctttctgggcctggaggctatccagcgtactccaaagattcaggtttactcacgtcatccagcagagaatggaaagtcaaatttcctgaattgctatgtgtctggggttcatccatccgacactgaggtgacttactgaggaatggagagagaattgaaaaagtggagcattcagacttgttctttcagcaaggactggtctttctatctcttgtactacactgaattcacccccactgcaaaagatga

SEQ ID NO: 14290 - DNA, 293 bp, Homo sapiens
  misc_feature 41: n = A,T,C or G
actaatttttgtatgtttagtagagacggggttttgccatnttgcctaggctgggggtttaagttaaatttttttaaaaaactaaagtgactggcactaagtgaacttgagattatcctcagcttcaagttcctaagataagggctttcttaagctttcaggtgtatttatcctctagatgtagacaataatgtcccatttctaagccttttccatttgcttctccgtaaattgatgtaccttccgaattgctgttatgttttctcctatactgtgagctatctgacctgcag

SEQ ID NO: 14291 - DNA, 204 bp, Homo sapiens
gaaacgcggaaccatggccgctgtggttgctgtttgcggtggtctagggaggaagaagttgacacacttggtaacggctgctgtcagccttacacatcccgggacttgacacggtgctttggaggaagagggttgttcacaaccaaggtatccagcaattacgggccctccccatttcaatggaaaatccttataaaggacccy

SEQ ID NO: 14292 - DNA, 248 bp, Homo sapiens
ttgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttgggactgatgaagttactgtaattgagattttggcatcaaggactaaccaagga

SEQ ID NO: 14293 - DNA, 107 bp, Homo sapiens
actttagaggtatatagattaggtactggtaagaagagatgcagatgcattaagactacttgtgatattgaatgatgaataaaggctattgattggagaaaaaaaaa

SEQ ID NO: 14294 - DNA, 283 bp, Homo sapiens
cagaacacattctattgacaatgtgtatactggattgcagactgttcttactgtaactacttcctgattaggaatatgaccatttgactgttcaatgattatttgtatttacagtttccagagtttgtcattataatagggacaatctttggctgtatacttttaaaaaatactctgctatttctcttgctgggacttttgaaaggaaatatatggactgatctattgctcatcagctttattttttaaacatacgactttattttgttggaacttgtcaaag

SEQ ID NO: 14295 - DNA, 306 bp, Homo sapiens
atgatgagatgactagcagatgcattgggatgctagctagatcatacaacccttattttcaaaaatttctacaaacaaaaagaaaaagcccaaaaaaaacatttcagctgctggaacagtatggacactgatcactgagtactgtatgtgccttgaggcattgtgtttttgtgtaacgagagtgccatactgatagctggcttctctttacatgggcattagattagggttcaggataggggtctcacataaatcacatacaacatgtggggggtgggctggtgtgggggctcagtctttaattcc

SEQ ID NO: 14296 - DNA, 223 bp, Homo sapiens
tgatatatactgtaatctggttttgaagtatctactattctggaatattgttaaacaactttctgcttttgaaaaaaaaaggtgccttgattcagttgcgtgacttagaacattcatcccattttattgtgatttttaatggtcttctgaccccaaactgtgttttttggtgcagtctggcggctgcaggcatagcgtcggttttgttccaataacagagacc

SEQ ID NO: 14297 - DNA, 216 bp, Homo sapiens
agcatgaattatactaatcctcataacaggagaatcaatcctcattcctagcagagatgagagctaagtccagagaggatccgagaacgctctagcctttcacgagctaatagggaagcctttatgacgcagactttcgaacgctacgccatggttatggatacaatgctgctataatcgctacttcaggagcgtcaagggacccataagacttag

SEQ ID NO: 14298 - DNA, 149 bp, Homo sapiens
tgtctactatttaaaaagttactgttggacacgggggggtttttcagggggttttccgaaaggcattgttttcccgagggtagacgactccttagcctagttttggcctctgaggagcctatccagagggcacaattgtgttggtggtg

SEQ ID NO: 14299 - DNA, 154 bp, Homo sapiens
atagtttaaatatgcatgtcatattactacaagctaataatcgtgtttattttgtgcagttgcctttgatagttcctggtttaaaacctattaagtgtataatcttacagatagtcatctacaaactttatggggaaagttcccagcccattcw

SEQ ID NO: 14300 - DNA, 145 bp, Homo sapiens
tcaggctctgcatgggaacgagtgtaaaccgtggctgtctcctgcagtgagccaccgcggcaggcacgtggactgttttactgacatcactcaaaagctaaagcaataacattctcctgccgttgctgagtccagctgttccatk

SEQ ID NO: 14301 - DNA, 267 bp, Homo sapiens
gtgattattttttaaagtcttctttcatgtaagtagcagacagggctttactatcttttcatctcattaattcaattaaaaccattaccttaaaattttttttctttcgaagtgtagtgtcttttatatttgacttagtaactgtatgaagtcatagataatagtacatgtcaccttaggtagtagggaggacttacactttctttaaatcatttatctggatttctatgttttattagcattttcaggaggcggattatctagaga

SEQ ID NO: 14302 - DNA, 278 bp, Homo sapiens
tcttgttttatgtcttgttcctaatgtaaaagtgcttaactgcttcttgggtgtattgggtagcattgggataagattttactgggtattcttgaattgcttttacaataaaccaattttataatctttaaatttatcaactttttacatttgtgttattttcagtcagggcttcttagatctacttatggttgatggagcacattgattttgagtgttcagatctttcaaagcactatttgttgtaataactcttctaaatgtagtgcctttaaagg

SEQ ID NO: 14303 - DNA, 192 bp, Homo sapiens
taatttttcatttatcacttttgaattgtgaaacccgcagatgtttgagtagaaagaagtaaactttattcaaataataatatttaataaagatattaacgtcaatggtgctgttcttttcatttttatatgctaatatcaaaacctgattgcttatgaggctatctataatcatgcagggttttaacttgg

SEQ ID NO: 14304 - DNA, 239 bp, Homo sapiens
agctcaaagcaattaagtgggaacatttttaatttaaaaaaaatttccaaatatttgtgggtccgacagtaatgatcaaaatatgaatgactttgggaaaatttacatgaagctcaagtgttaggattgacttatgaaataaattttatttctatccaaatttgaatgtccaaccattttttagttacttctttctaatcctaggttattccagacaaagtttggaaactaattttatg

SEQ ID NO: 14305 - DNA, 219 bp, Homo sapiens
aaggaagtagactagccaaaacaacttggaaaaaaaccaaagcttatcaccattgagtatgacattagccatgggtttttcatatatggtgtatatcatgttgaggaaattcccttctatttccagtttgttgagtgttttatcaatgaaaggggaattgaattttgtcaaaatgcattttcttgcatcaagatggatgatcatggtgtttaaaaaccc

SEQ ID NO: 14306 - DNA, 252 bp, Homo sapiens
gcattaaatatgtatacagatatctaactgaaataaaaagtgttttaataattaaaaggttaacatatgggcatatgtgacatatagtgatatagcatgtctctttagttttgttgtttttgttgttgatggctaaccacccatgcttgtcttaaaaattgataaggtaccactgcatgtaaattatgtaccaggtgggcccgagtttagtacctcaatattacaagagacccttcgctgcaacatcatggg

SEQ ID NO: 14307 - DNA, 242 bp, Homo sapiens
attgtttaggtatgagcagaagaggttaaggtatttctaaaggtaacatatagtcaagagtttcctcaaaatagttatttggagaagatcagaatgtctgtgtatttcttgtctgtttctatgttgtcttatagctctgactaaatgtgtttacctcatgcaaaagatttattaaagcatagaaaaggtgaatggattaaaattataaaataattgtcctcttttctttaaaacacacacaa

SEQ ID NO: 14308 - DNA, 288 bp, Homo sapiens
taacgggagtccaggttaaacactttaagatgagaaaattgatctctgtctgagctctgaagggtccgaagtgattttagctacatcaagtgatgaaaaacacccacctaaaaatatcattgatgggaatccagaaacgttttggaccaccacaggaatgtttccccaggaattcattatttgtttccacacacatgtaaggattgacaggcttgtaatccaaagtgactttgtacagacctggagagtgaaaaaagcacgtctagagagccagttgattttgagcam

SEQ ID NO: 14309 - DNA, 209 bp, Homo sapiens
tgtgaacactcttctcatgggtgtttacatgcctactcgaacaccacaggcaagtccttgggcagccagctactttgcaccctggaccccacaggtcagggtcagggactccccaccttttatacagtggggagagagtggaacctttgtctttcaacgtcagagtgggactgcactagaatcccagctttgtccagataccatttggk

SEQ ID NO: 14310 - DNA, 307 bp, Homo sapiens
tttatattaaggaccaaattcagttccttggtccttggaagacctatattctctgtagttactgaaaaccgaaagtcaattctaattattcatcttacattatttttccaccatgtcaatttgaaaactcggcttttcttctgcataagagattcttatgccaaaaccattaaacggaggaatcatttttttgctatgtaatacctcgcatctttgctctaaaatcaagctcagattattatttttcacgtgtgagcacgttaaatatcagatggcctcgtaaaataatgtcttttaccgcggtctc

SEQ ID NO: 14311 - DNA, 150 bp, Homo sapiens
tccaaaaggagctgcaattttaaagtcttctgatgtcatatcatttcactgtctaggctacaacaggattctaggtggaggttgtgcatgttgtccgttttatctgatctgtgattaaagcagtaatattttaaggtggactgggaaaaa

SEQ ID NO: 14312 - DNA, 268 bp, Homo sapiens
ttgtttatttttgctgctgttctcaacatcatcattgcctgctgatgtgccacgatgctgctccaatagacagcaataagattgtctctaatttgagcagtaacatgatttcaagagaccaagtttcacagcttgtaaagttctgtatttgggattcttgcttatttttccgcctgtgtttttctgagaacttattcctgatgatcaattgaatccagtaggtttctatagctatatgtttgtggtataagctactcgtaagagacty

SEQ ID NO: 14313 - DNA, 277 bp, Homo sapiens
actgggtggtaatgataattgaggcaaatgtatttattttggtgacattttgcatatatgcagagtttctgacataggaccttcaagatcctaggggggttttgtttggtttttaattgtgaggaataaaaaatcttctgcccacacttggcattttaaggtgacttaggtcaaacgttgtttccctagggtgaaatagcagcctaaacatttctcacgcaggggctttgggtattgctacgctgcaacacacatttgttgtgggctccccatattw

SEQ ID NO: 14314 - DNA, 253 bp, Homo sapiens
ggaaaagtatttgaaactaaattgacattaaaattaagatttgttttcaagtggatgtccattaaaagtagaaaaatattttgggataagtgagtgtgttttttccttacatggctactaaataaaatataatgagtatacaagtatatctcctcttttgctatggaggctccatgttcaagggcaatggctttttgaaatctgggtctatctaaaagtttgccccttggtttgacatatgtgcagagtattw

SEQ ID NO: 14315 - DNA, 208 bp, Homo sapiens
agtttgttcagtatgagtttttagaattatttcaaattgcaattatgcacaggcaataatttcctttactgatagagttttatcagtagtaaagaggaggataaagaagagaattaaaagcaaactgagaatttaaaatctgattcctaagcagaaaatacatttctgacccagcaggtgtataaacacaagttgtataaatagggcv

SEQ ID NO: 14316 - DNA, 236 bp, Homo sapiens
taagtgaaccaaaggtttttgtcctttccttcactgatttgctttaaaaaaaataaaagaaatgatttattgcagaattatgattctattttctcaatatgttaacttggaaaaaattttagccttatcttaatctgtcccaacggcaatttgcggatttttgcagattcaaaatctgaatggttatttacaagtcaatctactgaattcctgtttttaaataatcttttgagact

SEQ ID NO: 14317 - DNA, 300 bp, Homo sapiens
acatatgctgtctacaggaatacactttaaatgtaataacatggatatcttgagagtgaaaagatagaaagatatatacaatgcaaacaataagcatgagaaagctaggttggaatattaatattacaaagcatagactttatgccaaggagtactattagagataaggagggatatttcctaatcatatgtgtgaaattatcatgaatgcataagtcataaacatgtagacacacactgacagacaactagagagacattgtaaaatctacaataacacattggagatattaacacact

SEQ ID NO: 14318 - DNA, 258 bp, Homo sapiens
taaaccaactctatctgaaatcccaccaaaaaaaatttaactccatatgtgttcctcttgttctaatcttgtcaaccagtggcaagtgaccgacaaatttccagttatttatttccaaaatgtttgggaaacagtataatttgacaaagaaaaatgatacttctcttttttgtgtggttccaccaaatacaattgcaaatggtttttgttttatttttactcctcactgctctcttcacactgtgctcacagagcgca

SEQ ID NO: 14319 - DNA, 257 bp, Homo sapiens
atgtctcgctccgtggccttagctgtgctcgcgctactctctctttctggcctggaggctatccagcgtactccaaagattcaggtttactcacgtcatccagcagagaatggaaagtcaaatttccttaattcctatgtgtctgggggttcattcatgcaacattttagatgtacttactcgagaatggagaaagaattgaaaaagtgggagcaattagacttttcttatcagcacagaggagtgtgattatatat

SEQ ID NO: 14320 - DNA, 152 bp, Homo sapiens
tcaactaatgaagaaatgaataataaattttgacacttaaaaacattttattaataaagaatattgacatgagtataccagtttatatataaccccggttttaaacttgacaatcattacactaaaacacggtttgataaatcttattcaca

SEQ ID NO: 14321 - DNA, 170 bp, Homo sapiens
ctcactgaagcttaagtgaggatttccttgcaatgagtagaatttcccttctctcccttgtcacaggtttaaaaacctcacagctttttataatgtaaccatttggggtccccttttaacttgggactagggtaactccctcatgcaataaactgaaaagggccacaaga

SEQ ID NO: 14322 - DNA, 164 bp, Homo sapiens
tgaaggtgccgagctataaaccttcagaatattattagtctgcatgggtaaaagtagtcattggataactacaataccttttctttgcctaataaggttcttttgaattcaattcactaacacatttaggtatattcactgtggtttacacagagatatacaaa

SEQ ID NO: 14323 - DNA, 161 bp, Homo sapiens
accttcagatggaagtagttacattatagattactatggaaccagacttaccagacttgagttattacctaatgaaacaattagaaaaacgcattatatccctaaatattttttaaaaggaacagattttgaggcctccttgtttttaggagagggacctg

SEQ ID NO: 14324 - DNA, 160 bp, Homo sapiens
attcttcgagtgacagctgaagacaagggtacaggggcccaaaaataaggttcacatcacccattgacccggatcggcttgacactgaaggagatcggaaaggattggtaatgattttgagagaggttgcttaagggaggcaaaaagcttaaggggccga

SEQ ID NO: 14325 - DNA, 242 bp, Homo sapiens
acttcgctcgtactcgtgcgcctcgcttcgcttttcctccgcaaccatgtctgacaaacccgatatggctgagatcgagaaattcgataagtcggaactgaagaagacagagacggaagagaaaaatccactgccctccaaaggaacgattgaacaggagaagcaagcacagcgcaatgggaatgagggcgtgcgcccccacatatatcactttacacattcacacacatattctcttttat

SEQ ID NO: 14326 - DNA, 154 bp, Homo sapiens
aggcggacttgaggaaaccgcagataggttttgggctctttgaaagatagagattaatacaactacttaagaggtatagtcaataggttactaagatattgcttagccttaagtttttgacctaattttgatagcttaagattttaagagaaaa

SEQ ID NO: 14327 - DNA, 146 bp, Homo sapiens
gcctcacaaaggcgaggccagcgaagtccccgctgtggagcccaaaatcaagcgtggtcccagcagccgggcacagcgtagcaccctcaccataaattcctaaaagtgtcgtaaagaattttttcttccagagaaagacgacccaa

SEQ ID NO: 14328 - DNA, 162 bp, Homo sapiens
gcttatatatagcctcataatgttttaatgacatattctgttgacggttgtacatactcagccatgccctttcattttgacgatagtgtttctaatatttggtattggcattcccctccccccatttttggtattacttaaggtaggttatcacggaggcag

SEQ ID NO: 14329 - DNA, 212 bp, Homo sapiens
aaatcaacactctacatgcctccttgactgtcagtaatgacactggttccaaattcacacatatagacactactgccccccacccccaccccataggctaagattagttctgtaccagataaaaggggctggtccagggactgatatttactgacatccaaggtagtgctagaaggggcctttgagaatgcttccgccacctgtttccagct

SEQ ID NO: 14330 - DNA, 181 bp, Homo sapiens
gacgtcttatgtgctgagtattctctcaggtgtattctaattacagagtcattgagcttctccctccgctaggatccttacaagagcagggaagacagtagaggatgtataatttcggcgaaggtaaatacaatttatttgagggtattccaaaccgattatttggggttttcggggggtt

SEQ ID NO: 14331 - DNA, 149 bp, Homo sapiens
ttttttccaaacaaaacagcaaccaaggaagttggtggtaggaggatggcttcagggctccaagctcgaagtcaggatgcaggctcttctgtctctaccctctttgatgaccttgggcaagtccgttcttgtattaaggccttaagttc

SEQ ID NO: 14332 - DNA, 315 bp, Homo sapiens
gagattgcctcaaaattgtgtcacataatccacgytcatcttgcaaagcgctattttcaggcacatcattggaatacagggagtagccctgcacctgccagtgagctcgccattcactgattgggaagagtgacctagcatctttggaaatcaatgtgtgtcttcaggagaatgttgcagtgtcttgtaacaactaattataatgcaaattagggctacaatgtaatctgctttgttaatgaaaatgataaacagcatattgacaagctaggacactgtgtatctttaatgtatctcttcagagtttgctctatg

SEQ ID NO: 14333 - DNA, 166 bp, Homo sapiens
gcataaatttttaaaactagggtctcagaaaatatagcatggacttaaagtctagatgtgttttgttgacatttaaatatgaatagattgatgatttaatgtattggattttttcttaattatgaagtattatttaggtatactaataacaaaatggagacgtgtg

SEQ ID NO: 14334 - DNA, 588 bp, Homo sapiens
tttcccccgtcagtattttttaattagcagatggtgtattcgaacagctgtgattcagagacagaagaattttatatatgtgaaatgtaaatcaggtcttaattatgcagaggatgattgaggacacatttcttcttgagcgcatactcgggggttcatgggttctgccacacacaaatggtcttttaaaggtttggggaacatattgccaaatggcctggagaaaagtcatcctaatttacacccttggctggcagtgtatttgactgcttgttttcctgaactcctgccaacagagtattaccatatttaaacatttttgccaacttgctaagcagacaagaaagcatctaattattcttacaatgtacatttctgtaattacttgtgagaatgaagcatgcatgtggttatcgggcatgtctaattttattttgggaatggttgcttacaggtttatctcactgacttccagtagctaaaggaaggaatattcatatgggggggaaccagaacatctttaaaaacatggtcctaaaaaataaaggtatgggaaagaattggaaaatattaaaccaaaaaaaaaaa

SEQ ID NO: 14335 - DNA, 460 bp, Homo sapiens
gattcaaagacccttacgtgtcttaggactccagttttagaaacatttttttggaaattacctagttcagatctctatttatcatgtttttcctgtgtgatgcccttcatacaactattaacttggggatatttagctctcagagtatccttctcactatatataaatgcttcttcgtgctaactgcctgctaagcatttttaaatatattattagaaatgtttattaactaattggcagggactttttaaaattatgcagttctcagctaaatccaagaaatgaatgacagatttcttatgtagaaatttaaattcaactgaattataaggcacagtctatttctttagccttcacctgtttgggttaggctgggacatttgaacagagataaatgtaggttctaggtcccaaaaccaccctctagagattgcataagaatggggataatttaagcaac

SEQ ID NO: 14336 - DNA, 122 bp, Homo sapiens
acgatgcgaagaacgaggcaagacacagccctcccagattaaactcctgttagagacggtgccctaatctagagatgagagtgtaaagggagcctggaagggagccacggctcacttgtgat

SEQ ID NO: 14337 - DNA, 354 bp, Homo sapiens
cacagaaaggaatccccctctaaaatgaagattgttctatatccaggaaacctttgcaccaaagagagttatgactatctcaagactctggctggtgatgttcatattgtgagaggagacttcgatgagaatctgaattatccagaccagaaagtggtgactgtgggacagttcaaaattgggctgccccatggacatcaggtaattccatggggagatatgcccagcttgagccctttccagaggcaatttagatgtgggacattcttatctcggaacacacacacatatttggcgcatttgcgcatgaatatatactctacatccctccgggctctgctacgggggcatata

SEQ ID NO: 14338 - DNA, 400 bp, Homo sapiens
aatcataaacatatatacagtagagtggtgtatattagaatatagacctcgctaaaaaaaatagaacatacactttggagtccagtatatctaggttctcatcttctatgacttaagcattataatccctcatctctaaaacagaaatggtaatacttttaatctaaagggttgtttgggaattgtaattattattacctttggattggtcctcccacctttatgtgatgtgttttctcccccctaaattctctgttctacccacatgtgggagagatacacacccagtatatttgcgcccgtgctgctactatactgtgatagtagagcgctactatacacccattgtatagtgtggcgcccctgtttcgtctccggggggccggggcgcaagggtgtg

SEQ ID NO: 14339 - DNA, 245 bp, Homo sapiens
cttctgctgagggggcaggcggagttgaggaaccgcagataagtttttttctctttgaaagatagagattaatacaactacttaaaaatatagtcaataggttactaagatattgcttagcgttaagttttaacggaattttaatagcttaggattttaagagaaataatgaggcctaagaggagatccataaggagggaaagagaaaagggtccaaaacaaactcggaagtttgagatgtagcg

SEQ ID NO: 14340 - DNA, 147 bp, Homo sapiens
aaaaacatgaccagagaagcatgtgactcagataacgttccccggaagttgcagagcaatctgtggtgtctgtcatagcccaactagtcctggagcacatggacaattctgtaccccaataatcagaacaataaaatggtagttgtg

SEQ ID NO: 14341 - DNA, 360 bp, Homo sapiens
cttctgctgagggggcaggcggagttgaggaaaccgcagataagtttttttctctttgaaagatagagattaatacaattacttaaaaaatatagtcaataggttactaagatattgcttagcgttaaggttttaacgtaattttaatagcttaagattttaagagaaaatatggaggcttaggagagatagcatgagagaaggaaaagataaaaggtttctaaaacatgacggaggttgagatgaagctctcttcatagagtatacaatgtatataccacgggactctgagagacgaggcgtcccgagccccgcgttcttccccatagagagtgaactactttttagagcacactattg

SEQ ID NO: 14342 - DNA, 262 bp, Homo sapiens
cttagagttcaggaggaatacattagataatgacacaatcaaatataaattgcaagatgtcacaggtgttatgaaggggagagtaggagagaccatgagtatgtgtaacaggaggacacagcattattctagtgctgtactgttccgtacggcagccactacccacaatgtaactttttaaaggtttaaatttaaatataggtaacacttcacacacggagcttcccaatcacacatctgcgacacattaaagtgctcttag

SEQ ID NO: 14343 - DNA, 255 bp, Homo sapiens
caagtcaacccaacatctctactaataaatctcaccattttaaaaagaacagtaaattctacatctctattttggagaaaaaataattataatttcctttcatgctatttaacatatgcttatatatggacatataaattgtgaaaaggattatttaaaccaattgggcttaaggaaacttcagggaggaggttggatcctttggcctatatgcatatatcttttatatatgggtaaaaccccagtgtgtttccc

SEQ ID NO: 14344 - DNA, 300 bp, Homo sapiens
aattctgagtcacaggccaggaggggcctaggggtctttaacacttgtcctaggtgattccaacacaggtagtcaaagagccacactttggtaaatattgctttatgatcgtttggaaattattgggtctgataattgggacttaatgtaaccacaatcaccgtgtctccctttggctttcttgaatgctgtaacggtggctctctgtaacagatttgcagtgagtgtcccacaccataccccgaaacaaatatcacgtgcctctctgtgtcacgcgcgctcaggggatgtgttctctgt

SEQ ID NO: 14345 - DNA, 202 bp, Homo sapiens
ctkcctcagaaacttacttcatttattaagaaacaaaatgacttaaaggtaagaaaagaaaaaacacaattttcacaaattttcaccccaataaaagcaggtattgcttttctttcaataaattcccttaaggtaaggtcgttaaaaattaattcaaagagggttatttttaattacaaggcctttttttacaattttccca

SEQ ID NO: 14346 - DNA, 276 bp, Homo sapiens
tcattgcacacaagatggatggtcgccagcagtaccatagcctcagaaaatgttattttccttatttggaaaatggatataatcaaaatcatggaggaacgtttgtacagggtaaatctatagacgttgcctgccatcctggctacgctcttccaaatgcgcagaccacagttacatgtatggagactggctggtctcctacctcctagatgcatccgtgtcagctttaccctctgaaccttcgtgatcgagggtcatccctctccagcttgaagt

SEQ ID NO: 14347 - DNA, 267 bp, Homo sapiens
ttgctcaaaagaaataacctacagtcttaagatgtatcataaaaatgttctgccaaggatctaaattaccttgggtttcgcatatgtctatgaaattctgtgataatttgtttcagtacattgattcactggcgtctgtttgcatttgatactttgcgtaactcatcactggtggtacttgatctggacaggtaatattgtggatatttggacattggacagtgttagccagttgtattgatgtatcagaggtaaggagaacccatt

SEQ ID NO: 14348 - DNA, 270 bp, Homo sapiens
aggacttggatggtgagaaggggccatcatcggaagggscctgaggaggaggacggagaaggcttctccttcaaatacagccccgggaagctgaggggaatccagtacaggaggatgatgaccaaagaggagctggaggaggagcagagacctgaggattagcgaagttatccttagcgtcctcctaaaggcttttccttttggcatctcaaaagctgagagataaaccggaaccccagagaggagtctgggcaggctcccagggtgcat

SEQ ID NO: 14349 - DNA, 267 bp, Homo sapiens
ggaaaaaacaaaataccaccctacaaacctgtatttaaaaagaaacagaaatgaccacgtgaaatttgcctctgtccaaacatttcatccgtgtgtatgtgtatgtgtgtgagtgtgtgaggccgccagttcatctttttatatgggggtgttgtctcattttggtctgttttggtcccctccctcgtgggcttgtgctcgggatcaaacctttctggcctgttatgattctgacatttgacttgatccacaagtgaatctttctcc

SEQ ID NO: 14350 - DNA, 223 bp, Homo sapiens
ggaatttattgcagttctatcgttgcatatgcataaataatatgggcacagaaattttcacttaacattattttgatatcagaaataatttaaattgccatagtatttgatggttaaaccaattaaagtatgctcataaaatggaatgctctctgactctaataattgagaaaaggagtagagaaattcactatttggaaatgtggaaagcattcaagctatw

SEQ ID NO: 14351 - DNA, 251 bp, Homo sapiens
gaaatggattgatggggtgatctgagttattgtatataaacgctcttacaggactagaatgaacatcagctagataggcaaaattgacacattcagaacagctttttggactgcgaggcaaaagttgtcagatacagcaaagatcccttattattacagagtatttgacgtgtctctattttaggagagcaattaaatagagggcttcatgcatttggggagggtgctgaactctcaagttcgtcaacttw

SEQ ID NO: 14352 - DNA, 224 bp, Homo sapiens
tagtgattttgagataacagtgggccatactgagatgtttaaataagtagttaataagacattagaacttgaaagaggtcaagaaaggacataggcatcagtgaaccattcacatactaatgacagttgaagtgctttagtgggagagattgtgatagagaatttagaggaggcatgatggaatcttgtagagaggctaattctaggcacattcggggggaggg

SEQ ID NO: 14353 - DNA, 246 bp, Homo sapiens
gatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacc

SEQ ID NO: 14354 - DNA, 227 bp, Homo sapiens
caaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacggttaacccaagtcaataggagccggcgtaaagagttttttagatcaccccctccccaaaga

SEQ ID NO: 14355 - DNA, 184 bp, Homo sapiens
ggacctctgctgctataactccgaaaccgacacgtggagattgcttgggcgctacgcttgcacttataggatgacttcggagaacttgatactaatttgggacttttgctgcgggagtttgctggcaggacttgagtgacaatgacttatggcacctagtcagggtgttagccaatagtttatg

SEQ ID NO: 14356 - DNA, 246 bp, Homo sapiens
acacctgaagaactgagagccatcaaacaagtttatgaagaagaatatgggctcaagcctgggaagatggacgtggtggggggacacttcagggtactatccagcggatgttggtggtttctccttcagggctaaacagagacccctgatgctggaattgatgaagctcaagttgaaacaaagatgctcaggctttatttcaggctggagaacttaaattggggacagatgaagaaaagtttatca

SEQ ID NO: 14357 - DNA, 242 bp, Homo sapiens
ttatcgagacaaaggtgtccttcataatgaagttaaagtgagtatactgtggagaggacttccaaatgtggttacctcagctatatcactgcccaacatcagaaaacctgacggctatgattactatgcctttcctaaagatcaatactataacattgatgtgcctagtagaacagcaagagcaattactactcgttctgggcagaccttatccaaagtctggtacaactgtccttagactg

SEQ ID NO: 14358 - DNA, 256 bp, Homo sapiens
ttttagctaccactcatcattatgtcccaatataatgttccagttcatgttgcaaatagggcagcaccctggctattgtgtggtagtctgtaagtagtgaaatagctgtggggtaaggcagttagtctttcaccttagggagggtgcgagcccagacccacttgaccatctatcacaaatcttgctgaagttctaagatccctttcaactacaaattttcatgcttccatagaatcatccctgacctcaggggaaa

SEQ ID NO: 14359 - DNA, 253 bp, Homo sapiens
tttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaacattattgaggaaattaatatcacagcataaccccaccctttacattttgtgcagtgattattttttaaaggcttctttcaagtac

SEQ ID NO: 14360 - DNA, 225 bp, Homo sapiens
aaaaaaataaatatgtaaagagaaaaagtctttgagtaggtgaagggtaattggatttagagctaaagggggagttttttttattaattctcatctttgtctattgtaaaaaaagagagagcaagtcaagtatgagtgaagatgcaggctaaagtatgactaagtcaagtatgagtgaagatgcacattaaatggccaatgcagatacgagtcttggacagcttc

SEQ ID NO: 14361 - DNA, 240 bp, Homo sapiens
ttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatccttcttctgcttgcacaaggttcttgggctggaccctttcaacagagaggctta

SEQ ID NO: 14362 - DNA, 240 bp, Homo sapiens
  misc_feature 212: n = A,T,C or G
ctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggnaacacgtgctcatcgatgtgggaactgg

SEQ ID NO: 14363 - DNA, 243 bp, Homo sapiens
ttttctgtcagcacatcttattgaaggaaattctaaataatgtatttcagatggaaggaaagtgatctcagatggaaagtctgaaaagcagaaagaaatgaagaacaaaaaaagtggtaaagatgtgaaaagactagtcacagggagaagacattgctatatatatttcctagcaaggactagcatttagaatatataaagaattcggccaggcgtggtggctcacacctgtaatcccagcac

SEQ ID NO: 14364 - DNA, 226 bp, Homo sapiens
aaatgtacaaacttagaagaaaattggaagatagaaacaagatagaaaatgaaaatattgtcaagagtttcagatagaaaatgaaaaacaagctaagacaagtattggagaagtatagaagatagacaaatataaagccaaaaattggaataaaatagcactgaaaaaatgaggaaattatttgtaaccaatttattttaaaagcccatcaatttaatttctagtt

SEQ ID NO: 14365 - DNA, 227 bp, Homo sapiens
ccctttttttgctttaacaattatagattttacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgttaactgaagggagggt

SEQ ID NO: 14366 - DNA, 258 bp, Homo sapiens
ttctgctgagggggcaggcggacttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggag

SEQ ID NO: 14367 - DNA, 260 bp, Homo sapiens
ccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagttgatgttcaaccggatcgatggaaaagccagcacc

SEQ ID NO: 14368 - DNA, 257 bp, Homo sapiens
cttctgctgagggggcaggcggagttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatgg

SEQ ID NO: 14369 - DNA, 248 bp, Homo sapiens
cagcaagccgaagttggcctgtgggctgtcgtttgctgacctctactgtacatcaacacttggtaatgtcagtgattttgattttagccattctagtaggtgtgtactggtatctctgattttagtttatattttcctgatgactcatgatgttgagcaccttttcatgttcttactgaccatatctagagttaaattttagggtgtttattcaaatcatttgcccattaaaagtttatcttactatt

SEQ ID NO: 14370 - DNA, 250 bp, Homo sapiens
tccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgccttacggatcatttcaaacctttgtggggccaggaaatgtcccccaaatttgggctgttcaaactcatggctc

SEQ ID NO: 14371 - DNA, 251 bp, Homo sapiens
cttcatgcctttagatgtacaggctgacagagaagattcccgagagtaaatcatctttccaatccagagggaccaagcatgtctctctggcaagatccatctaaactggagtgatgttagcagacccggcttagagttcttctttctatcttaagccctttgctctagagggaggttctcccgctttcagttcaactcacagcttcttcaagcatcacccggggagtttcccgggggtttctcataaatga

SEQ ID NO: 14372 - DNA, 270 bp, Homo sapiens
ttctccacaccctactcttgccagatgttcatgtaagtgagagacctgactgtaggacttttttgtatggttgaatctacaatgaggttttaagggatgtaactacatgtaaatcaaaggtacatcatgtcttgttttatttggggttttttccaggggctgtgccccattttggaaatgttcattaaagagacaaatggctcaaagggtttgaggtgaacagagcacacacccctaacccgagttgcactttacaggcatttgcagaga

SEQ ID NO: 14373 - DNA, 251 bp, Homo sapiens
agcagacaatgtgggctccaagcagatgcagcagatccgcatgtcccttcgcgggaaggctgtggtgctgatgggcaagaacaacatgatgcgcaaggccatccgagggcacctggaaaacaacccagctcttgagaaactgctgcctcatatcccggggaatgtgggctttgtgttcaccaaggaggacctcactgagatcagggacattttgctcgccaataaggtgccacacttctgcccctgctttg

SEQ ID NO: 14374 - DNA, 261 bp, Homo sapiens
taagtaaaatggagacaataaacaaacaaaaaacaaaaccaaaaaaatctcaaaaaccaaaaccacccaaaacatacaaacaaacaaaaatgaatgagaaaaggagtggttctttaaggaaatccacaagattgtacaaactcttaaccaaattaaacatggagagagaagatcccatttaacagaattgtgaagaaaagagggatttttagggccacccaggggcacccggagtattataagggtgtgttttgagagact

SEQ ID NO: 14375 - DNA, 268 bp, Homo sapiens
aagtactcagcactgccagaacaaggaattaagtaccctcagcaattcgctgtcaagcccttcaaggaggccagaggcaacccggaaataagacccataatactggtaggaacattaaggataaaggggcggcccataaacaggggtgggcgcttcttttgctgggtgggccagcagcacccccaaacaattgaacgcattagtatcatatgcaaatactgtttgcatgaaaagcgataaatataaaacagcgggcccctaaccttca

SEQ ID NO: 14376 - DNA, 484 bp, Homo sapiens
gtagcacaaacatagatatttatttatctaagtggaaaagaatattgtaattctcagtgttggtaactgctcctgagattttaaaacgatacaacattttttcagagcaagttgttgatatgtatcaaaagtcctaaagacacacccttttacccgtcaattctacagtcgagtcatctttctaaaaaaaaaaagaatgtgttagacatgttagaaattttaccacaaagtgtgcatccaaggattatttgaaaaattggaaacaggcaaatgtctaattacgggggaccatgatatcagtaaattatggtatactttgatggctaaatactactgcatcattaatacattgtattgtattgactatttcttgacatgcgaaaatattcaaaacatacagctttaaaaaatgggctatgaaacagtgtggctacggtgcacaccagggcctggggtttctctaaaggaaaatcttttgaggcag

SEQ ID NO: 14377 - DNA, 537 bp, Homo sapiens
gagcatttaagaagcatcctctgccaagacaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcgatagagcatagattctataaattcctacttgtctaaagacaagtaaatctgtgttaaacaagtagtaataaaagttattcaatct

SEQ ID NO: 14378 - DNA, 365 bp, Homo sapiens
gaaagccaaaggctagtttctaggcgctcttttggtttgattttgaaatccgaaaaatcagcattgaagttatatgtgtgtgtgtgtgtgtgtgtgtgtgtgtatgtaagaaaagttcagtaaacacctttagcacccaaattaaacactagttagcatttttctataatatatttttatgtttactcatctataatgccatcatagatttatgtattatctgcatataattttttctgaaatatttgataagttgcaggtatcatggcattctacccccaaatactccagcgtgcatttactaaaaataagaacattttcgtgtatcaacatagtgccatactcacacccaagaaaaataataa

SEQ ID NO: 14379 - DNA, 506 bp, Homo sapiens
gcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtatggagcacatgttactgcttcattttggagcttgtggagttgatgacttcctgttttctgtttgtaaattaattg

SEQ ID NO: 14380 - DNA, 169 bp, Homo sapiens
aaatacattccaggaagagcgaagagtgcgggtaatgacatggagtcaaaaggctatattccagccaggcacagtgactataatctcagcttctcggcaggttgaggcagggagatcgcttaagtctaggagtttgagactagcctgggcttagcaagaccctgtggcg

SEQ ID NO: 14381 - DNA, 211 bp, Homo sapiens
ttacaaattacaagataaaacttgacatgttagaaaaagaaaagaatgctgtgttagacagaatggctgaatcacaagaagctgaattagagaggctgagaacacagcttctatttagtcacggagaagagctttccaaacttaagggagttttagaaattaaacatcggattaatatttaaacaaccttaaggatatttagggacttaca

SEQ ID NO: 14382 - DNA, 226 bp, Homo sapiens
aactacaaatttattttgtagaaatatggaaaccttaatactattaagatgtaaatcttaatactattaagatgcaaatcttaatactattaagatgcaaatcttaatagtatttttataaagtgaaaacaatattttcactttattcctttaagttgggcctgaggaaattttcagggaaaaaaaaataagagtttggtatagacactttggaaaaccacaagga

SEQ ID NO: 14383 - DNA, 211 bp, Homo sapiens
ttggtaatatagaaaggtgtatgcaagttgaatttgctgactccagcacagttaaaaggtcaatattcttttgacctgattaatcagtcagaaagtccctataggatagagctggcagctgagaaattttaaaggtaattgttaattaggatttgtaaccttttaaaggggctcttgttttgagcagggtatctacatttactcttttgtt

SEQ ID NO: 14384 - DNA, 209 bp, Homo sapiens
aagaagcaaagaagcctacggaggaatgctattcttatgtcctggaagtcaagttagggggatattgaatctggagcaggcttgttcaacccatggcccgcagcccgcatgcagcccaggacggcttttaattcagcacaacacaaattcattaattttcttaaaacggtttttaggatttttttggtagataatgttagcgctaataa

SEQ ID NO: 14385 - DNA, 221 bp, Homo sapiens
  misc_feature 193: n = A,T,C or G
catggaagaaagcagttccatcagagagcccaggagttcttcagctagggaaaatgctcactgaaaaagcaatggaaggtaaagctgtaagaatatttggttccaaagctgcctataactcatgatatccccaacaaaaatacaagggttaagtctttgggcaacataagggggaattccctggtcacttacnatgggggttttgcaccccactaagagaa

SEQ ID NO: 14386 - DNA, 214 bp, Homo sapiens
ccactctttactcagtggcaatgtacggtggattagttcttttcagcatgtttctttctgttatgataccccagaaagtaattcaaggcgtgccagaggtatcaccattgtatgggggttcaaaaattatgatcccattaactcgatgctgagtatctacatggatacattaaatatatttatgcgagttgcacctatgctagcactggaggca

SEQ ID NO: 14387 - DNA, 202 bp, Homo sapiens
taaaagctaaaaccataaaactcctagaagaaaacataggggaacattttcttgatattggcctggggaaatgaatttttttttgatgtgacacaaaaggcacaggcacagaggcaaaattgggcaatgagactgcatcaaactaaaagcttctgcacagcaagggaacaccagagaaaaggcagtctatggatgggagaca

SEQ ID NO: 14388 - DNA, 221 bp, Homo sapiens
accgaatccaaaataacagctacaaccacacaagtaacatctaccacaactcaagataccacaccattcaaaattactactcttaaaacaactactcttgcaccccaagtaacttcaacaaaaaaggcaattccttcccaggggggttattgaccaaccctgaggagccagggtaaaccaaagggcaggggtactatttttaaggcgccactctctctaaa

SEQ ID NO: 14389 - DNA, 199 bp, Homo sapiens
  misc_feature 170: n = A,T,C or G
caaatcctttagaaaaaaagaaggggtaccttaacagcctaaagggttaggtttaaaaggtgtgggggtaataacaccaatttagggcggaatcttttaaaaggggaagtaaaccccaaggggtaaaaaaagacccctttaaaccaggtcgcaggggagaaaggggcaanaatttaagcccagttatacgaaatttacc

SEQ ID NO: 14390 - DNA, 181 bp, Homo sapiens
ttggattctgtttatatggtatccctttaagttttctggttgaataattaaggttttctggttggttctttaccttaaacgggaggactcttttctgcccctccccggttgccgcctcttcctagcttgcccctccctggggtgccctaacccgggtgtctcatagtttgggtggggtgcc

SEQ ID NO: 14391 - DNA, 167 bp, Homo sapiens
accagcctggccaacatggtgaaaccctgtcactactaaaaatacaaaaattagctgggcgtggtagttccacttgtaatcccaactactggggaggctggaaccttggaggcggagatttcagttggctaagatcgttccacttcaggcttagttagacttcattt

SEQ ID NO: 14392 - DNA, 240 bp, Homo sapiens
ccgcgatgcgtttcctggcagctacattcctgctcctggcgctcagcaccgctgcccaggccgaaccggtgcagttcaaggactgcggttctgtggatggagttataaagggagttaatgtgagcccatgccccaacccaaccttccagctgagcaaaggacagttttacagcgcttaattttaccctcacaccgcacatatttagtttctaagcgcgcgcagggccgggtgtgcatatg

SEQ ID NO: 14393 - DNA, 230 bp, Homo sapiens
agaactcaaaaatatagcacatttatagttaaagaatgcagaagtaaatttataaatagaaacaaaagtggccagtatccacagggtgacaatcaatggtattccacagggaacaatttcttggaacaaggattattttcagctactacaagggtttctatatagtgtaactaatgtccactctctgcagtattgtaaaataggctcatcacagagacgcgaagtggatt

SEQ ID NO: 14394 - DNA, 237 bp, Homo sapiens
gtagatttacaaaggcctacagttctatacagataggaatgaactattggcttactgaatggggattactttctgtggggctcggaactacatgccctaggatataaaaatgatggtattaatatagggttcttacaggaggaaatttagttatatgggtgttagattccgaccccaaagtcatatttacacaggttattcagtgtatgagaacaaatgcgcacatatgagtctata

SEQ ID NO: 14395 - DNA, 167 bp, Homo sapiens
aaaagtcctaatagtagaagaaccctccataaacctggagtgactatatggatgccccccaccctaccacacattcggaggacccgtatacataaaatcttggcaaaaaagggagggattggaccccccaaaggttggttaaaggcaaccccaatggctctccagat

SEQ ID NO: 14396 - DNA, 233 bp, Homo sapiens
atggaatgaacattgctaaagaatcttgtgttcgctttactttaaaaaggtatttttttcctaattataaaactgatgtgtcaattacgggaaaattaggaattcagcacaaatacatggatattttaccccacaaattgccatatatatatctctgtctcttttggggggggtgaaattttttgcacatgtgtctcggggaaatatctctatacacagaaatatatagtgct

SEQ ID NO: 14397 - DNA, 235 bp, Homo sapiens
tatggctaaggtgcaggatgagaagagaaaaagcaaacagaaattgggggcgtttttgtggatgcaaagaaatttacaggaccccttctaccctagaggtccaagggaattcaagggttgcttcagggccccacggagggacattgaagacatttcttatgtgtagtgtccctgcgcagggatttaccagagccaagtgctttaacgttacgggagatactttactttggggata

SEQ ID NO: 14398 - DNA, 211 bp, Homo sapiens
aaagccttagtcaactttaattcaaaaataatgaaaattatctttggatgtccccttttagaaaaccccagcaggaaaccgtaaccgctcatgtccttaggaaaaagtagaagaaagaacaaaattattctttaattcccacaagggacccgtaaaccccaatgtgaaaaaggggtctttcttttttttctttgccccacaaatggataaa

SEQ ID NO: 14399 - DNA, 319 bp, Homo sapiens
tacagagtgttctgtaccagtgtttcattcattccttttttcataaccaaggttccttagttttaggatttaatatttttaaaagttttacattgctgtatattcaaagatttgttttattaatatgcaataaaggctagaaattttagttttattcctaattggaaaatatggttaactatggaatatatttacttcccctagtgaatgtcccctatataatgactaatttgggagaaatgtgtgctctgtaaggtgtgttttaaattgaacctgttttaaaagaactgttgaggggcaacaaaaatccaggcaaccc

SEQ ID NO: 14400 - DNA, 141 bp, Homo sapiens
cccattgacctctagtggtgagtttctagaatactggtccattcatgagatattcaagattcaagagtattctcacttcttgggttatcagcataaactggaatgtagtttcagaggatactttggcttgttttgtttagg

SEQ ID NO: 14401 - DNA, 175 bp, Homo sapiens
cggagtcgttgaggtctccgcgccgctccctgtacaaactggtgggctcgccgccttggaaagaggctttccggcagatatgcctggagagaattagaaacagccgggacaggctcctaaacagggaccgccaggctggaaggagtgggccaaggaatttttaaaaacaactttt

SEQ ID NO: 14402 - DNA, 310 bp, Homo sapiens
aatagatatagtaccgcaaggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccctctatttagcaaaatagtggggagatttatagggtagaggggacaaaccttccccgcctggtgatacctagtgtgttcaccaatagagtcttatgtttaacattttataatttgcccccggacccccctcatt

SEQ ID NO: 14403 - DNA, 308 bp, Homo sapiens
ttgttcgtcttctctctcctcgatttgttgcgcgcttcattcttcctctcgggtctacttcataattacattgttcttatttagaatgtgattacattaattctagatcattttgctcaaaattaaacaagttggtaattccgagattgattggccataccattgtccaccctgatttacctctcaagtgcatttcactcgggtcatttttcccttctaaccctacccctttgccccttggggtgttatatcgggacacaaatgggggccccgggtggacaacggggggtgtttttttccaccccaac

SEQ ID NO: 14404 - DNA, 197 bp, Homo sapiens
cagagggacaagcattggagcggggaagggcccccaagtccgccgggacaggggaatttttgagcgttaaataaagaatcgtgtggaagatgggtacgaagatgtgggaaggagtcccaccaccgtgtgaagaatttaacagtgtaatccagtgccccgtgttttagcgtattgaaaggcgggaagagaggaaaagg

SEQ ID NO: 14405 - DNA, 365 bp, Homo sapiens
ataatcttcagtctcgacacacagctttttataggtggacagaaactgaaggtaaaaaggcccttatagggatccaaaattggttccaggcttttaggaggttgttaaaactttacaaaaaaaccctgtggcctttactttgggcacaaattaaattaagagaggggcgaaaggcacagaggttttttaaagcacaatttagggttgggacattctctcttttattgcacacctgtatataatgcccatattgtattttgaatatcgccacaggggctctcttatctcacctcataaaaggaggtcctgttggggatattatatactccctcaagcttatacgcgggggcctgcgatgtcagccc

SEQ ID NO: 14406 - DNA, 212 bp, Homo sapiens
acgttggccctttttgctttttataaaccaaactctatctgaaatcccaacaaaaaaaatttaactccatatgtgttcctcttgttctaattttgtaaaccagtggcaagtgacccacaaaattccagttatttatttccaaaatgtttgggaaaaggataaattgaaaaaggaaatggtaaatttctcttttcttccttgtgtcaccaaat

SEQ ID NO: 14407 - DNA, 174 bp, Homo sapiens
ttacttgttttcatcacatctctgtatcttcagaattggaagaagaatgtgaggctgtactgtgggcctttgtataagaaaacaaagaatttacaaatgggagagtaatgaaagggggatgatctattctagagttgcaggacttaagccggggagtagagggacccactagaa

SEQ ID NO: 14408 - DNA, 155 bp, Homo sapiens
agcaatggtttttaacaaggcatgagccagatacgcagtcagtctgactagggttagttgggatctctccatttcttagcaactcttcctcagtgaaggtccccttattttggggctttgcccaatggcaaggggccaataaacaggtcttaggg

SEQ ID NO: 14409 - DNA, 184 bp, Homo sapiens
gtaagcagaagatatatgtcatacctcatttgggatagcataacctgagatcttactactgatgagaacattatctgcatatgccaaaaagttttaagcaaattgaaagctaccattttaaagttacgggttctaccattttaaagttaatttgcttgtcaagctataaccacaaaattactgg

SEQ ID NO: 14410 - DNA, 213 bp, Homo sapiens
attctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttccggaattgctatttgtctgggtttcatccatcccccattgaggtggacttacctgagg

SEQ ID NO: 14411 - DNA, 222 bp, Homo sapiens
cctgtatgaatggctccacgagggttcagctgtctctacttttaaccagtgaaattgacctgcccgtgaagaggcgggcataacacagcaagacgagaagaccctatggagctttaatttattaatgcaaacagtacctaacaaacccacaggtcctaaactaccaaacctgtcattaaaaatttcggttggggcgacctcggagcagaacccaaccttcga

SEQ ID NO: 14412 - DNA, 279 bp, Homo sapiens
acgatgtgtgaaatttgcttaaaagggaattttcatgatttgatttagattagtatttaaatatctgctttagatagcaattaattttattgtaaaaataagggaaaatatgtgaatatgtgaattttttaagcctgagagatgatagaatgttcccatatttctcttgtaaagagaataatattttgacttacacatactgtagagagataccacctctttccccttgtattacagtacactgtttacattactatactgtcacgctgagagtatata

SEQ ID NO: 14413 - DNA, 327 bp, Homo sapiens
aatttgaattaaataaaatttaaaaattcatttccttggtgatactagtcatattccaggtggctagtagccacatgtagctagtgactactgtttttaacagtgaagatctagaacaatttcttcagctcaagaagttctattgaacaacaggacttctctagcaaattaggacagcaatcagggttggcctatattgagggtattagatcccaggtgaggttctgtgtatttttaacctatagagcagaatatctcgtcattttcaagagatatgtctccgagagagtgtactctcggtgtatacacgtgactcacagcattttw

SEQ ID NO: 14414 - DNA, 150 bp, Homo sapiens
caatgcatatattacaaaaatgactaactttattagactttcagacctacttgaactacatttaaatttaagtatttgaatcacctcccttttccccacttctgtgggaatttatctgtaggtgtttgattctgtaataacccaaaaact

SEQ ID NO: 14415 - DNA, 112 bp, Homo sapiens
gaggaacaagcatgtctctctgccagatccatctaaactgggagtgatgttagcagaccagcttagagttcttctttctttcttaagcccttttctcttgagggaggtctcc

SEQ ID NO: 14416 - DNA, 114 bp, Homo sapiens
ttaataaacgatgccccttagctattagcatattacatattgcattattcacatatttcacatcacctaaaagaagtttgttaaccccgttacgctagtttgaacccaaacccm

SEQ ID NO: 14417 - DNA, 224 bp, Homo sapiens
agtagggagaagcaatgcgagatcccggaagtaggccgaagtataaaaccccaaatcaagaggtaaagctgggcccttggtttctcaagttgcccacttggccctcttccaagtgtacttttcttcctttccttactgttttaaagctttttaataaacttccactcctgctctggaaaacaaactttcattcaaaaaaaaaaaaaaaaaaaaaaaaaaaaaaa

SEQ ID NO: 14418 - DNA, 632 bp, Homo sapiens
cgaaaacgccaaagacaatttttaaatagttaaaagtgttggccgagatagaggaagtcaatcatagtcttggaataacatttagatttcagaatttgagtttttatgtttgttttgacaaaatggttcttttgctttcttcaacaagaggtttaaggctttgaactttttgaaactttgatataattgttgaagttttttaaacaaatcctatagaaataggagactgctaatatgaagaagatagaacatactattacagcaaatttatttactcacaaaaattgcttttccaaggtaatctttttcaaaaacttactgacattttaatgccaagtgtgttttctttgccctagttttaacagtttaaaatcatgattaacctttttcctgaactgaaaggaatctggccaattttttaatctatgcttaaaagccctctttgatatgtttctcataggcaccattatattaaatagaaaatgctcagtattccctactgatgcttattctgtatcccagcactcatttagttaagattttatgcttgatcattcagtcattcaaagaggagtactgtccttgttcagctgtccagacatcactgggggttgtttggatggattgatagg

SEQ ID NO: 14419 - DNA, 690 bp, Homo sapiens
tgaaaagtatacacaaagggctctgaagctcaagtcagaggagtgggaggtctgatcattgttggtggaaaaacgtaaggttattttgtgtttttaagttggttttacaattctttcctggggaaattatttctggaggggaaaaagatccattctacgtatccttgtggagaaaagctaaataacctttaagaatgtgggtggtattggagaaagaagatgaattatagctccggagaatcaagatcttaagtgaagcctttctgttcagatgtgatctataaaaaatcataatttggggaaaggttaagcaaatctggctttgtagcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgcatcgtttacccaaatatctgaatggtcatctggaactcatgggttttgggctcataagatggccactctgacacaggcattcctccggaataatgtggatctttgagacccgtggcagtgacacaactaaatccctcatattgaagggactcatttttttgccaacttttttgaaggaagccttgacggagggc

SEQ ID NO: 14420 - DNA, 659 bp, Homo sapiens
tgagtatttcaagcgctcaaatgcattgctgtatcttgcgtttatctcacaacgaactggctgatagaggaatacctggaaattctttcaatgtcgtcatccctggatgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctaccgtgttgctaaccgaagtcactcttaattaatatctgtatcctggaacaatattttatggtatgtttttctgtggtcagttttcatagtatccatattttattactggttattacttccatgaattttaaaatctgagggaaatgttttgtaaacatttattttttttaaagagaagatgaaaggcaggcctatttcatccaggaccacccccatttacccgaatagacatcaaactcaatgcttatttgggaaaattaggggttttttaatttctaccggcaaatgaagtgcaaaacctttactggttgcatgggaatcagccaagtttataa

SEQ ID NO: 14421 - DNA, 159 bp, Homo sapiens
agtaggaaactaaatcagaatggatatcattgacagttgggatccatggacctacatggaaagaatgaattcaccctcttggatttcataaattccgatcaagagcagctatgtaatttgacccaccaatggtgttacaaggagtcaaaattctttatb

SEQ ID NO: 14422 - DNA, 221 bp, Homo sapiens
gtgttttctgcagttatttctcttgttctggccaaacaaccctaaaaatccttaccattccacaaagttggaccatcacttgtgcacccactttgactatgagtataccaccacagtggaattctgtttgcacaatggtcttcagggagactggactacttgttggtcaggggcaacttgaagtgtaaaggaaatgtaggcaagggattgcccaattttaa

SEQ ID NO: 14423 - DNA, 220 bp, Homo sapiens
gcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagagactgtgttactgatgataaaagcctctggtagcaataaaaa

SEQ ID NO: 14424 - DNA, 217 bp, Homo sapiens
gggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacattgagttatga

SEQ ID NO: 14425 - DNA, 177 bp, Homo sapiens
aataagagaaaagtgatgggagtgaaaaaatcgtgtttgtgcgtaattttgaaatatatcctcacacctggaatgccagcacttttagagactgatatgaaaggctcacttgagcccaggagtttgagaccagcttagataacaaagggtaacacttttctccgcaaaaaaaaaaaa

SEQ ID NO: 14426 - DNA, 176 bp, Homo sapiens
tcaatattttagatgcaaagttgtcatctatcccaggcctagatgatgtcacagttgaagtatctcctttaaatgtcaccagtgtcacaaatggagcacatcctgaagccacttcagagcaaccacagaacagtacacaagactcttggactacaaggaaagtgaagtatcaacca

SEQ ID NO: 14427 - DNA, 163 bp, Homo sapiens
  misc_feature 38: n = A,T,C or G
atgtcagcttatttgatttaccttcgtcactctcaccntgatcatactgactcctttatgttacatggatttgctgtcaggcaccaccctgagctggtcaccatgtttttattactttagtcattgacatcttgtcagcaggatcaccatcctttgcccaggg

SEQ ID NO: 14428 - DNA, 174 bp, Homo sapiens
tttagtagagatggggtttcaccatgttggccaggctggtcttgaactcctgaccttaggtgatccacccacctcggcctcccaaaggtgctggggattacaggcatgagctactgcgcccagccgtgtgtatgtttctgaaatgatgatggggcggggttaaaatctaaaggg

SEQ ID NO: 14429 - DNA, 189 bp, Homo sapiens
gggcttctcctctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttccacaacattggctgcatgtgcatcacggtctttagc

SEQ ID NO: 14430 - DNA, 318 bp, Homo sapiens
aggcgtcgcgtcgctagctagtcgttctgaagcggcggccagagaagagtcaagggcacgagcatcggccatgcctttcttggacatccagaaaaggttcggccttaacatagatcgatggttgacaatccagagttgtgaacagccctacaagatggctggtcgatgccatgcttttgaaaaagagtggatagagtgtgcacatggagtcggttatactcgggcagagagagagtgcaagatagactatgatgatttcgtagagtgtttgcttcggcagataacgatgagacgtgcaggtaccatcaggaagcagcg

SEQ ID NO: 14431 - DNA, 321 bp, Homo sapiens
tgaaatcttcagagaagaatttctctttagttctttgcaagaaggtagagataaagacactttttcaaaaatggcaatgatatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggcataatggttaaaggtgtggatgaagcaaccatcattgacattctaactaagcgaaacaatgcacagcgtcaacagatcaaagcagcatat

SEQ ID NO: 14432 - DNA, 318 bp, Homo sapiens
cactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagctgttatgtgagacatgtttctttgtaatgagaccacattggagatgt

SEQ ID NO: 14433 - DNA, 176 bp, Homo sapiens
aagagcaaactagcaaaactggaacagtaagctaaagagttactccaaaagaacaaagataatggtggagggtgatttcagagacatgtaaaataaatgcagggattccagtaactcatagttccaaagagagacacatgaaataattttacggaggaaaaaaaaaaaaaaaaaaa

SEQ ID NO: 14434 - DNA, 247 bp, Homo sapiens
tgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggctgtcgacgttggccctgtttgcttttttataaaccagaactctatctgaaatgccaacaaaacaaatttgactacatatgc

SEQ ID NO: 14435 - DNA, 260 bp, Homo sapiens
tgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagacctkggaggagattgcacacactgaatctgctacaaacttcaar

SEQ ID NO: 14436 - DNA, 195 bp, Homo sapiens
atttataaaaaaagtgactctatattagttttaaggtataaatgagacacttttcctatctgtaaactagctgatctatttgtagtctggcttaaaatgtgacttgcccaaacataggataatcttccaaaacaggatctagactgtggtaattaaaaatcaaaattaggttaagagtcaaacgatctaaattga

SEQ ID NO: 14437 - DNA, 259 bp, Homo sapiens
cctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctatagcttctgcataatgaattaactagaaataacttttgcaagggagagacaaagctaagacccctgaaccagacgggctacctaagaacagct

SEQ ID NO: 14438 - DNA, 229 bp, Homo sapiens
ctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttgggaaagaaaaaaaagaggctccgggttgacaaatggtgggggtaacagaaaggaactggcta

SEQ ID NO: 14439 - DNA, 270 bp, Homo sapiens
tgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatacatccgacattgaagcttgacttactgaagcttggagagagaattgaaaaagtggagcattcagacttgttctttcagcaaggacttggct

SEQ ID NO: 14440 - DNA, 263 bp, Homo sapiens
ataaaatgctgatatttactggaaacctagccagcttcacgattatgactaaagtaccagattataatgccagaatataatgtgcaggcaatcgtggatgtctctgacaaagtgtgtctcaaaaataatatacttttacattaacgcaatttaatgtttctctggggttggggctcttggctttcagagtttggttaatcaggtttgattctagatgatccaacataatggacccctcccgtatgtagactttaattttgtct

SEQ ID NO: 14441 - DNA, 314 bp, Homo sapiens
gacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctcacaaataagagatcattgaaatgctgaaaattttaacagtcttcttaaaagtattgagggggcaaaaattgaccattattggtttacaaaaataagcctataaatgtgtttcacacagct

SEQ ID NO: 14442 - DNA, 422 bp, Homo sapiens
aatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttagggtatcgggatgtagaccgagggatatgcatccataccttgacaaaacaactaagagcctgtgtacagtgtagctgtcagtcctcatggcaggtatctcgcaagtaggttcttttgacaaatgtgtacacatctggagcacgcagacaggtgctctagttcacagctatagggggacaaggtggatatttgagtk

SEQ ID NO: 14443 - DNA, 382 bp, Homo sapiens
gagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagagatgcaaataccttcatatccctcagcagagatggagagctaaagtcaagagaggatccgagaccgctctaagcctgttcacgagctcaatagggaagcctgttatgactacagactttgcggacgctacgccatggtttatggatacactgctgcctataatcgctacttcagggagcgcgcagggaccacattagacttagggaaga

SEQ ID NO: 14444 - DNA, 243 bp, Homo sapiens
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctggggttcatccatgccacattgaaggtgacttactggagggtggagagagaattgaaaaaggtgagcay

SEQ ID NO: 14445 - DNA, 215 bp, Homo sapiens
ggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaaggccctgttaactttgtgaaataacttcccatttaaacacacttcacagtacagggaataaagtatatgaaagaccaaaa

SEQ ID NO: 14446 - DNA, 319 bp, Homo sapiens
acattgcaaacacataatatctctactttgatgattttaggttgcatccctgggctatggattcctgttaatctgtctgagccatgggctgccacaattgctttacattttgtgaaacttcttctaactcagtttactcattgtgtccgtagaggcttaggcatgataatttttgctattgtttacttggtcacactaataatttctgttgtgatgtcctctgtagctttgcatagttctattcaaacagctcagtatgtggagaactcggacacgcacagtcaaccaagggtggctacttgagaataaaattaacact

SEQ ID NO: 14447 - DNA, 466 bp, Homo sapiens
ctatttctatcattcgttagtagtagagattcttaaattgaggtctctgctctatacatatacctgcatgcatttgactgtggagaaaagttgcagcattgaccagattttcaagagatcattaaattgtgttatcttttttccatctatccctactttttcaactttgtggtcacagtactgccattagagtagatggaaaaaaaaccttgtgtatttagcttctgttttgatctctctgcatagcttgttctgaattcctattggagagattcaatgcatagcagaccacagtacacctgaggtgaatgaaagtggagctgcagtgtttgttgttgtcctatgttgtcaagactttgctttttgtggccatagatggtgaaccttacagttgatctgtatatttctggtttatctcaagaatgtgggtttcatcctatggagttttaaaagtcaatgcatattt

SEQ ID NO: 14448 - DNA, 206 bp, Homo sapiens
  misc_feature 36, 38, 47, 73, 87, 107, 108, 114, 134: n = A,T,C or G
agaaggtgcctttcacatagtaattaaaagttgttntnttggaaatnttaatgaataaggcccgtgttgcatncgctaccacacctnttaatcccagcacttcttgnnagactnagggctgggcaggtcacctnaggtcaggagttcaagacttgggaaaacattttaagtgggtccattttcaaggcatgataaatctaagtact

SEQ ID NO: 14449 - DNA, 105 bp, Homo sapiens
  misc_feature 74: n = A,T,C or G
aaagaggatgtgagacatacacattcaaccagaatatagdaataacgaggaatgaatgagataccaaaggaagnaaaaaggtgggcttgaaattgggggaaatat

SEQ ID NO: 14450 - DNA, 183 bp, Homo sapiens
  misc_feature 46, 105: n = A,T,C or G
tcctcctcaaccacaccatcttggctggagttcacagcaatgaatnactctggtggtttagaacggaaactgaggaatgaggaaaccagcccgtcctctctttgnaagggataaacaaaccctcccccctacccaaatttccaagggcaaagggtgggggttgtaaaaaagggtgagatgggb

SEQ ID NO: 14451 - DNA, 184 bp, Homo sapiens
  misc_feature 46, 71: n = A,T,C or G
ggccacaataaagtttacttgtaaaattttagaggacatttactcntaatatgttgcacgtacactcattnttacagggcgtggagactcattgtatgtaatagaatattctgacagtgagtgacccggaggtctcttgtgtaccctcttaccaagtcaagctgtccttcgaggcacgtcaatw

SEQ ID NO: 14452 - DNA, 200 bp, Homo sapiens
  misc_feature 6, 46, 47, 103, 104: n = A,T,C or G
ggccanacaagaagactgtcaggaagggtcggagtctgtaaaaccnncatacagtttggcttttttcacagtggaatcatttttatatgaaataaaatgatanntgccatttatggtgtagttctgagtactgagacttttctgcgtgatggctattccttgcacaacaggtgtttgtgagttgggctgttgagatgcct

SEQ ID NO: 14453 - DNA, 172 bp, Homo sapiens
  misc_feature 68, 99: n = A,T,C or G
gtgtaaagggtggtggtcacgtggcccagtgtttatgcgtagtcgtcaggtccatcttccaagggcgntggtggcctattaccagaaatatgtgggatnaggccttccaagaaggagatcaaagacatcctcatccagtatgacctgaccctacctggtggctgaccctcgt

SEQ ID NO: 14454 - DNA, 211 bp, Homo sapiens
  misc_feature 47, 72, 73, 102: n = A,T,C or G
tttcagattggtggaccttccccttggcttacccttttataaatggnggctacggcaagaaacttcactgannttcacacgatttgtttgacatcgacccanttgtagccagatcagtttatcacctagaagacattgtcagacagaagaaaagacttgaaccagataaatcccagaccaaagagagtctacagtatgcattagaaaccct

SEQ ID NO: 14455 - DNA, 213 bp, Homo sapiens
  misc_feature 6, 37, 45, 46, 47, 71, 72, 100, 101: n = A,T,C or G
ttctcngaggttacagtcaagctgtcagctaggtttncagtcatnnntagactcaactgcttccctactgnnatagttgttaacaagactcactttcctnntggctgttggctggacacttcagctcctggcctcttcacagataaggctgcttgcaacgatggcagcatttgttttcctacagcaaatcattgcaagaggagcaagaacccm

SEQ ID NO: 14456 - DNA, 214 bp, Homo sapiens
  misc_feature 47, 71, 72, 101, 102: n = A,T,C or G
aacctaccgagcctggtgatagctggttgtccaagatgagaatcttntttcaactttaaatttgcccactnnaccctctaaatccccttgtaaattttatnngttagtccaaagaggaacagctctttggacactaggaaaaaaccttgtagagagagtaataaatttaacacccatagtaggcctaaaagcagccaccaattaagaaagcttg

SEQ ID NO: 14457 - DNA, 307 bp, Homo sapiens
atagagtaaggacaatgattgacatatgataaaataaatacagtggaaagatattatttgaaattggcaagtcacataataagcatagaagcaagatacaagcaaacagtacaaaggtaactgttaaggagatattcttgtctaaaactgggtgatagggagaaggagggagataaaattggattattttattattgctacagtagggaccccataaatactatgcctaaagacatagaggactaggtattatcagagtatatacatgtatatagtactagtacagaagctgagatcattccagcta

SEQ ID NO: 14458 - DNA, 193 bp, Homo sapiens
ttctgtttaaatgaccaatactttttgaaattgatgtacttagtttcaagattcatagattctgttatctatgtagacagaattggtcatgtatattttctattagttgagtttttacattctttagaaaatgtaaaattcagtatagtttgaaagcggcacacttaaaaattaattttctaacacacaaaaa

SEQ ID NO: 14459 - DNA, 311 bp, Homo sapiens
atatgcagccaaccaagatgcaaatgttttgaaatggtatgaccaaaattttaagtaggaaagtcacccaaacacttctgctttcacttaaggtgtcttggcccgcaattactttaaggaaccaaggcatgatctggttactgtgatattttaaatatccacagtactcactttttccaaatgatcctagtaattgcctagaaatatctttctcttacctgttatttatcaatttttcccagtatttttatacggacaaaattgtattgatagcactcagtttgcagttgatagagagagatttggtatat

SEQ ID NO: 14460 - DNA, 186 bp, Homo sapiens
accttgagatttagatttagatttagattagaaaatttctaaatttgtacattttatcaactcacagagtgttgtttctacagtgtatttagatacaggagtggagaaaaaagccaaacaatagtatctctaagtagggctttcaaaatgtcacaacgattgttcacaaatgccctcaatttgggg

SEQ ID NO: 14461 - DNA, 172 bp, Homo sapiens
tgggaattagaaaagggtaatatctagtaagaacaacttgggtataaaagaagaaatagagcaatagcgcgtcccatagcaggaaattgtagacacaaagaaaccgtcactatttgttacctcaaccatgaagaatgttttttctttttgtttcctaacgacaaatgtacct

SEQ ID NO: 14462 - DNA, 616 bp, Homo sapiens
atttgagtcattggtaatctaatgagaagtttctctagatgctggaaacagaaaccagatttcgccacaggttgcagaatagattgaataggaagaggttgggcttggaaaacataagaaatagaaaacctcggtgttaagattttttttcaatgcttggctttcataaagagaaggatttcaggttcaacataaaattggacatatttatgtaatggtaggaaagtgtcaatagagagtgtgtattgaagaaagaggaaagacgggataattaagcaaatgcccagaggtgagtaggatcggtaagtgatggatggattagccttgcataagaatcagatatgtctttatgtaccattggcagataattttataggtagaggacagaaagttgagggagttctttcatgttttttcattatgtgaaagaaaatacagcccactgaaaaatttgagaggggacactaaaaagccttagaagaaataaaatttctagtagtttcctaggggaataggaaaagggtattttagaataaaataatgaagtaagcaaatagaaaattcaaaggatgactcacaaaaaattgaaaaaaaaaaaaaaaaaaaaaaaaaaaaa

SEQ ID NO: 14463 - DNA, 636 bp, Homo sapiens
acctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccctgaacagtatcaatgtgtttatgaaaggagatctaaatcagacaggagttggtctacatagtagtaatcatgtggatgga

SEQ ID NO: 14464 - DNA, 587 bp, Homo sapiens
gcaggaggacatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatgggctcgtcacccttcgtggaaatac

SEQ ID NO: 14465 - DNA, 246 bp, Homo sapiens
ggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgttaaaaaaaaaaaaaaaaaaaaaaaaaaaa

SEQ ID NO: 14466 - DNA, 266 bp, Homo sapiens
ccaacaaaaaaaaatttaactccatatgtgttcctcttgttctaatcttgtcaaccagtgcaagtgaccgacaaaatttcagttatttatttgcaaaatgtttcggtaacagtattaatttgacaaaggaaaatgataacttctctttttttggctgttccaccaaatacaattcaaatgctttttgttttatttttttaccaattccaatttcaaaatgtctcaatgggtgctataataaataaactgcaacactctttatgata

SEQ ID NO: 14467 - DNA, 246 bp, Homo sapiens
taaaaataagatgttctgtctgaaggctaccatgccggatctgtaaatgaacctgttaaatgctgtatttgctccaacggcttactatagaatgttacttaatacaatatcatacttattacaatttttactataggagtgtaatagggaaaattaatctctattttaggtgggcccattgttagtctttcaccatcctttaaactgctgtaattttttctcgcattgactctaaagcaaagatat

SEQ ID NO: 14468 - DNA, 195 bp, Homo sapiens
tggaggacattccctgttgactgcgtcgcgatgtgtggcgactgtgtggagaaggaatatcccaaccggggtaatacctgcctggagaatggatctttcttactgaactttacaggctgtgcagtgtgcactaagcgggattttattctgatcaaaacaaattctgaaaggaggagtaggagaggaattagtacc

SEQ ID NO: 14469 - DNA, 115 bp, Homo sapiens
aaaattttttaatctaaaattttttattggtttaagttttttaaaggggaaaaaagatttttaggggggttttttttaattaagtttaattttttttagtaattttttttttgta

SEQ ID NO: 14470 - DNA, 143 bp, Homo sapiens
aaaccaattttttggggaactttaaatttaataaaaatttgaatttcattgaaaaaaagctttaacaaaaaaactggattaaagggaaatcaaaaaaattttaaataaaaaaaaaggttgctaaaaaaaaacaaaccttgatg

SEQ ID NO: 14471 - DNA, 120 bp, Homo sapiens
  misc_feature 12: n = A,T,C or G
aagagcttagantaggaagcagtctttattgacgacccatctctccagacagtttcttttataatactcaccggactgtaccgttcttatagtcatatcaatacagtccctttcttacag

SEQ ID NO: 14472 - DNA, 118 bp, Homo sapiens
tttatattaatactttttaaatttaaagaatttttatgtttatatgaagaaaataacttaggaaattggttttttaattaaatttttaaaattttttatttaaaaaaatttttttttt

SEQ ID NO: 14473 - DNA, 121 bp, Homo sapiens
ggaaaaataaaagtggaacctttgaattttggggtaattagaaaaaaaaaaaatttttaattgggggagaaggttgtttatggggagaatatgtggaatggaaataaacctaaattcaagg

SEQ ID NO: 14474 - DNA, 109 bp, Homo sapiens
atttggttttttcttaaaaaattttaagggtaaggatattgatggatttttggtatgtttttatggctttataaaatgcgttttttgttgaattgttaatgatttttct

SEQ ID NO: 14475 - DNA, 263 bp, Homo sapiens
  misc_feature 38: n = A,T,C or G
tgcttgaactgtttcctttactcatgttgaagggactntgttggcttttagagtgttggtcatgactccaagagcagagcagggaagagcccaagcatagacttggtgccgtggtgaaggctgcagtccaattccgtgatgctgcttttcagtgtccctcgataacaatcaactagacaccatcaggaggactactgaggctctgcgaccttcaagagctgagactgcctctctcctctagaggacagaactacatcttggga

SEQ ID NO: 14476 - DNA, 265 bp, Homo sapiens
atagatatagtaccgcaaggaaagatgaaaaattataaccaagcataatatagcaaggactaaccctataccttctgcatactgaattaactagaagtaactttgcatggagagccaaagctaagacccccgaaaccaggacgaggctacctaagaacaggctaaaagagcacacccgtctatgtagcaaaatagtgggaggatttataggtagaggcgacagacctaccgagcctcgtgatagctggttgtccaagatagaatc

SEQ ID NO: 14477 - DNA, 265 bp, Homo sapiens
  misc_feature 37: n = A,T,C or G
ggcctagtgttgtggtgcttctggtaatggtaatagngctcaactatttttttgtggatttcagtttttatcatcagaagtcctagacagtgacattttttagtgggtgggagtccagctcatgcatttctgattatacaaaacagtttgcagtaggttatttgtcatttcagttttttactgaaatttgagctaaacatttttacatgtaaatacttgtatttaccaaggatttaaatcagttgattaattaattaactcagat

SEQ ID NO: 14478 - DNA, 253 bp, Homo sapiens
  misc_feature 38: n = A,T,C or G
aaagataacaagaagaacagaactaaaaagaaacctanccccaaaccaccagttgtagatgaagctggaagtggatttggacaatggtgacttcaaggtcacaactcctgacacgtctaccaccccaacacactaacgtcaggacatctcccaagatcacaacagcaaaaccaataaatcccagacccagtcttccacctaattctgatacatctaaagagacgtctttgacagtgaataaagagacaacagw

SEQ ID NO: 14479 - DNA, 267 bp, Homo sapiens
ttatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttaggggtattccttcccccattgatactgtttttactaggtgcaactgtgaaggaaaaactttcttctttaaggattctcagtactggcgtttgaccaat

SEQ ID NO: 14480 - DNA, 260 bp, Homo sapiens
agcatttgtggtgttctacttctagtacctaggcagcaacctttgctgtgttgtttccattacaaagatgccagtcttttaaagataggaaggagttgtttgcaaatggcatttaaagaatagatagagagttagtgggaaaaaattaggagagtggtagtggaagtcaagaaaagcgtttcaagaagtatggactcaccgtcgaacagtgccaaatctgaaggggtcagctagataggactcaaatagccattcggatg

SEQ ID NO: 14481 - DNA, 266 bp, Homo sapiens
  misc_feature 38: n = A,T,C or G
tgtacttcctgtggaaaacaactgtcaactctggaganaaaaatgttctgcaggcaatgtaaagaagagaggaagattttagagtggacttgaaacttggaagaaaggaatgtcttaggtttttattctaatgataggcccatgtcagctccaccttggtgactaaaccctcgatagaaaagacataagggtctttctgttatgaaatgagaccactgggaaatgaaggacaatcttgcaaaaaagatagccaaaagggggaagcc

SEQ ID NO: 14482 - DNA, 263 bp, Homo sapiens
cccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagagtcacttgatcccaggaggtgttgcagtgaaccaagatcacaccactgcactccagcctaggcaacagagactctgtctctaaaa

SEQ ID NO: 14483 - DNA, 263 bp, Homo sapiens
ttgaggcagccagcgcaggggcttctgctgagggggcaggcggacttgaggaaaccgcagataagtttttttctctttgaaagatagagattaatacaactacttaaaaaatatagtcaataggttactaagatattgcttagcgttaagttttaacgtaattttaatagcttaagattttaagagaaaatatgaagacttagaagagtagcatgaggaaggaaaagataaaaggtttctaaaacatgacggaggttgagatg

SEQ ID NO: 14484 - DNA, 231 bp, Homo sapiens
  misc_feature 29, 30: n = A,T,C or G
tttgtgcttttgaccctcggaatcaccgnngcagtttatttgcgactcatgcttagctatcttaagataaagaaggctttcagctttgacttcaattaaggaagaccaacttatttagattcaagaatcttatctacagatgttatacttgggcgatatacaatttaccttggtcatggagccaggatagcaacatcatccagagtttgtggatctgatctccagagttgg

SEQ ID NO: 14485 - DNA, 399 bp, Homo sapiens
tgctagtgtttagcgctggtctttgccgggcgttgagggcagctcagccttcttgtttgtccggttcgcctgtgcgttggtactaaagggcaccagtattccgcggtcggcagcatgggtcgggagtcacgccactatcgaaaacgatcggcatccggggttcgctctggaagtcggtctagaagtcgctcaccctcagacaaaagaagtaaacgtggagatgacaaacggtctagaagtagagatagagataggaggagagagaggtctcgtagcaggtataaaagaagatctcggtcaagggacaggaagcgtctaagacgttccagaagtagagagagagacaaaagccgagagcgaagaagatctcgaagtagaaacaaggaactaagtttaagg

SEQ ID NO: 14486 - DNA, 346 bp, Homo sapiens
ctcatttttataacctggcaaaatcttgttaatgtcattgctaaaacataaataagggctagatactggaaacctaactgcaatgtggaggttttacccacatgacttattatgcataaggccaaatttccagtttaggtaattgcctacaataaaagggaaattttgcctgccattttcagagtcatcttttgaggctttctgttgatgttaactgagctactagagatattcttatttcactaaatgtaaaatttggagtaaatatatatgtcactatttggtaaagcttttcttttttaatttccaggaaaaaataaagagagtatgagtcttctttaatcca

SEQ ID NO: 14487 - DNA, 403 bp, Homo sapiens
agtacaacctgaacttctcaggaagcagtactattcaagaggtaaagagaaatgtgtatgaccttacaagtatccccgttcgccaccaattattgggagggaaaggccaacttcttgctacagagggctcaatgtgtcttgctgaatcaggccctctcttatccctgccatcgacttacagtgggaagaagatctacacctgcacagacccgggaacagtcggaagaacacatcaccgatgttcatatgggtgagtgatagcgatggagatgactttgaagatgctacagaatttggggtggatgatggagaagtatttggcatggcgtcatctgccttgagaaaatctccaatgatgccagaaaacgcagaaaatgaaggagatgcttattacaattaacag

SEQ ID NO: 14488 - DNA, 317 bp, Homo sapiens
acaacagtcttcagtgtacaaatataattgatacttgttcatcagtgtaatcctaacaaatctgttttataggaacagagtgatgaaacaaatgggctctgattaggaatcccccaattcaaatccaaaactttactacttcccggaaaattttccctttgggaggattttgttcacccaattgccatatcattctgatgtataggggaggatagagataaaagtgccctccctatgaggattaagtagttaaataaaagtaaaccatctaattaggatagccctcgcacacaaatatgcaataaatgctagctcaa

SEQ ID NO: 14489 - DNA, 146 bp, Homo sapiens
atggtggatgttttccctctccctacgtttagaaaccattcttaaaaacttttgaaaatatagaaccattaagcctgctattatcttagcaaattaatgggttaccctttttttctgatttaaagaacaaggaggcccaaaaaact

SEQ ID NO: 14490 - DNA, 202 bp, Homo sapiens
gccctctccaccctgcactgtgttcttggaaggggatcatgaatggtttccttgcattctgccttctgatttgggtcagccaatgagagaccatggcaagacatttgtgagaagggtagagagtcaagtcaaggtgtcttagttagatcaaactcttttctctctcccctgttgttaactcaaaatttcaccctgagggcgg

SEQ ID NO: 14491 - DNA, 210 bp, Homo sapiens
tagctgtgctcgcgctactctctctttctggcctggaggctatccagcgtactccaaagattcaggttttactcacgtcatccagcagagaatggaaagtcaaatttcctcgaattgctatgggtcttgggtttcaatccctcccacattgaagttgtcttacttgaagaatgggagaagaattgaaaaaggtgagaaaaacacactctc

SEQ ID NO: 14492 - DNA, 168 bp, Homo sapiens
cccagtgaatccgcatttttatgtaaacagtaagggaacggggcaatcatataagcgtttgtctcaggggagccccagagggatgacttccagttcccgtctgtcccttggtccacaaggatttccccgacgctaattattgagggaggcgtggtagggtttttataa

SEQ ID NO: 14493 - DNA, 222 bp, Homo sapiens
ccttctaactacggtccaatgaagagtggaaactttggtggtagcaggaacatggggggaccatatggtggaggaaactattggtccaagaggcagttgaggaagttggggttattgtgggaggagcccatacttagcttcttcctattttccatgggcttaaatttataaataggagagagattagagacccacaggtgaacacaaacacacttcagggta

SEQ ID NO: 14494 - DNA, 110 bp, Homo sapiens
tttcccccccaagacgcattttaaacgaaagcctggggccttttttttaaaaaacgtaaaaaaatacacaacacacacacacacacaacacacacacaacacacagaact

SEQ ID NO: 14495 - DNA, 202 bp, Homo sapiens
agcaacaacctgatgagtattcaagcgttttaatgcaatgcagtacctccgtttatctcacaacgaactggctgataggggaatacctggaaattctttcaatgtgtcaaccctgggtgtgagctggaatctgtcctataacaagcttaaaaacaaaccaaccgccaaatgataaaccttgtaactttttccctgggggccg

SEQ ID NO: 14496 - DNA, 225 bp, Homo sapiens
ccgagatgtctcgctccgtggccttagctgtgctcgcgctactctctctttctggcctggaggctatccagcgtactccaaagattcaggtttactcacgttatccagcagagaatggaaaggtcaaattttcctgaaattgcgtatgtgtcttgggggtaaatctatctccaattttaagcgtgtttattattttatggaggtgtgaagagagttatataaaag

SEQ ID NO: 14497 - DNA, 190 bp, Homo sapiens
  misc_feature 160: n = A,T,C or G
cgcacgcctgtagtcccagctcctcaggagctgaggtaggagaatcaattgaacccaggaggcaaagggtgcagggagttgagccaagatcgcgccattgcaacctagccttggcaacaaagcgagattctttttttaaaaaacccccaagtgttttttntaggggcattatatccctttcaagggaaaa

SEQ ID NO: 14498 - DNA, 225 bp, Homo sapiens
  misc_feature 191: n = A,T,C or G
actgagcagtcaggagctgttcaggcttctcccaagtgaactcacactctggggtttgccccctatgaaggtgtcctacagaattgggagaggatgggctccatcttgtgttctgtatgaagccttaccaccagggggggggcacattaaaacagacaccccacgggtcaaaggggttgacaaccccgccngacttacactttatagggggaactctctcttttt

SEQ ID NO: 14499 - DNA, 205 bp, Homo sapiens
ctctttctcatagttgaaaagaaaaagcagcatagatttggtgctcttctttaagggtgaggctcatttccgggctttttttgaggtttggtgatttccagaggcttggagattgagttaggggtcacttggtttctgatggctgtccttgcatttccccttttttcagggccatttaaaaaatggttttttgagccaactacac

SEQ ID NO: 14500 - DNA, 112 bp, Homo sapiens
tggcaatggtgcctgtgatccggggggaacctgttggcgaaaatttggggacggaagaggcactgccgcggggggcggatactgcgcctgcatcgttttggcctgaaaaaaa

SEQ ID NO: 14501 - DNA, 191 bp, Homo sapiens
  misc_feature 161: n = A,T,C or G
tcctctttttatgttgagttgctgcttcccggcatgccttcattttgctattgggggcaggcaggggggatggaaaataagtaggaacaaaaaagcagttgttaagatggtatggggactgtacataccagtgaagagataaaagggtgaaggattaaagnggatattatagacacggtttattcactttt

SEQ ID NO: 14502 - DNA, 196 bp, Homo sapiens
atatgtgttctttaaaacatatttaaaacatacaggaatagagtcctgtatgtatgttctactttatttattaaagtagaccctaatctggttcatcaaatgagtttcaaacaatttcaaaagattgggatactacaaatatgcttcttggttataattaactaattaggaattaaaaagggaacaattaatattt

SEQ ID NO: 14503 - DNA, 296 bp, Homo sapiens
aacagatttgataatcttattcacagttgttattgtttacagaccatttcattaatatcacctctgtttattcctcctctccctcccattgcatggctcacacctgtaaaagccaacagattcaaattgcatatatcttttcacgcgttcaaaactcagtgtattcacttaccctcagttcattataaaatgtttctcgggcattgtggatataaacactgttagggtattctacaactgtcactgggaaattatttccagccgagttaataccctcttttttgtgtacacaagtr

SEQ ID NO: 14504 - DNA, 311 bp, Homo sapiens
gcggcgacttctctacccctcagggtggctccacggacccagcgacatgcaggggctcctcttctccactcttctgcttgccggcctggcacagttctgctgcagggtacagggcactggaccattagatacaacacctgaaggaaggccttgagaagtgtcagatgcacctcagcgtaaacagttttgtcactgggccctgcaaatgccctcagcagaagccccgttgccctcctcggagtgagcctctgtgagagatagtctgtctgagactcttataatctcgtgtccacagcgaccacaggggatat

SEQ ID NO: 14505 - DNA, 267 bp, Homo sapiens
tgtctacaaaattggtggtattggtactgttcctgttggccgagtggcgactggtgttctcaaacccggtatggtggtcacctttgctccagtcaacgttacaacggaagtaaaatctgtcgaaatgcaccatgaagctttgagtgaagctctttctgggggacaatgtaggcttcaatgtcaagaatgtgtctttcaaggatgttcggtcgtgggcaacgcttgcttgagacagcaaaaattgcccaccccctggagggagcgtgc

SEQ ID NO: 14506 - DNA, 221 bp, Homo sapiens
ggcagctttggggttgctttggagggattgcccccaaaatgagagaccaatggatgggctcaatctggtagaactctgtcatgagatatcacgagataacagctgccagaaagggtcagtaggttttcaattgacataattatccatttcatccattaggcataatgtgtgtctaacatatgtgatatgtaatgtttattcactcttggagaggacagaga

SEQ ID NO: 14507 - DNA, 302 bp, Homo sapiens
ggatgccttaaaggaaccaatgagtccctggaacggcagatgcgtgaaatggaagagaactttgccgttgaagctgctaactaccaagacaatattggccgcctgcaggatgagattcagaatatgaaggaggaaatggctcgtcaacttcgtgaataccaagacctgctcaatgttaagatggcccttgacattgagagttgccacctacaaggaagctgctggaaggcgaggagagcaggatttctctgtctctctcaaactctttcctccctgaacctcagggtcactcaatctcgagw

SEQ ID NO: 14508 - DNA, 327 bp, Homo sapiens
aatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctcttgcgagcatctctgtgtgtcccatggaacactgcataacccgctttctttgaggagtgtgacccccaacacggataagcacatacaccctctaaggagtgtgggccactcctttttgagtttaaagagagaggacatagatgaaaatctctcgtgt

SEQ ID NO: 14509 - DNA, 324 bp, Homo sapiens
tcatttacataaatattatactagcatttaccatctcacttctaggaatactagtatatcgctcacacctcatatcctccctactatgcctagaaggaataatactatcgctgttcattatagctactctcataaccctcaacacccactccctctttaggcaatattgtgcctattggccatactagatctttgccgcctgcgaagagtccggtggggcctagccctactagtctcaatctccaacacatataggcctagattacgtacataacctcaacctactccaatgctaaaactaatcgtccccacacttatattacy

SEQ ID NO: 14510 - DNA, 253 bp, Homo sapiens
aactctctgtgctagtaaccacattctcctgatcaaatatcactctcctacttacaggactcaacatactagtcacagccctatactccctctacatatttaccacaacacaatggggctcactcacccaccacattaacaacataaaaccctcattcacacgggaaaacaccctcatgttcatacacctatcccccattcttctcctatccctcaaccccggacatcattaccggggtttcctctttaaaam

SEQ ID NO: 14511 - DNA, 166 bp, Homo sapiens
attctgaagctgacagcattcgggccgagatgtctcgctccgtggccttagctgtgctcgcgctactctctctttctggcctcggggctatccagcgtactccaaagattcaggtttactcacgtcatccagcagagaatggaaagacaaatttcctgaatttctc

SEQ ID NO: 14512 - DNA, 173 bp, Homo sapiens
tcagagaagaattctttagtcttgcaagaggtgagataagacactttcaaaatgcaatgatagaattcctaagcaggcctgctttttgaaaacaagagcaggtatatttcaaacctataaggccaccaagggtggcccggatagccggtagccctctccaccctaaatcaatc

SEQ ID NO: 14513 - DNA, 215 bp, Homo sapiens
agttagtactaatatgcgcaagcagtaaagaagggggtttattagggtccagataattaaatatagattataaagcaaaaattgatactacattttttgttgctgcttttgttaatacttttaggtagctgcgaggtgccaacaaggctaaattctgcatccctcaaacagccttatatcactcagacttattttccagtcggtactgttgttgg

SEQ ID NO: 14514 - DNA, 266 bp, Homo sapiens
atttaagaagcatcctctgccaagaccaaaaggaaagaagaaaaagggccaaaagccaaaatgaaactgatggtacttgttttcaccattgggctaactttgctgctaggggttcaagccatgcctgcaaatcgcctctcttgctacagcaagatactaaaggatcacaactgtcacaaccttccggagggggtagctgacctgacacagattgatgtcaatgtccacggatcatttctgggatggggaggggatgtgagatgatc

SEQ ID NO: 14515 - DNA, 264 bp, Homo sapiens
gagcctctctccctactgctgctacacaagaccctgagactgacctgcaggacggaaccatgaagagcctgatccctcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaaggcctgtccacgagctc

SEQ ID NO: 14516 - DNA, 264 bp, Homo sapiens
gaataaagccaaagaattccttggcagcctgaagcgccagaagcggcagctgtgggaccggactcggcccgaggtgcagcagtggtaccagcagtttctctacatgggctttgacggagcgaaatttgaagatgacatcaactattcgcttaacagagatcgaaatggacatgaatcctattgcggttactaccaacgtcactattatggaggctcttcaatttgtccccgagacccctacggctttaggcaatgagacagcgt

SEQ ID NO: 14517 - DNA, 212 bp, Homo sapiens
agggaaatgtgtgtaagaaagtatattaacaaatcaatgcctccgtcaaggaaacaatcatatgtatactttttttctacgttatctcatctccttgttttcagtgtgcttcaataatgcaggttaatattaaagatggacattaagcaattatttatgaatttgtgcactgttggattttctgatcaatcaagttcttgaatttgattctm

SEQ ID NO: 14518 - DNA, 263 bp, Homo sapiens
atcatgccgaaagaacaaccagtagaaggcactgcatcctaggattttaatttgtgtattatctagtcaaaggttaaaatatttaaagaaagaaacttaaaaaagaatctactatataaggcaagcaatccctattctgagtctttcattttataatgttccaaatgcagaatatctttaactctgtacatgtcattttccagaattaattgtaccaaagtacatttcctaaacgttttttttaaagtttttggcagtaagta

SEQ ID NO: 14519 - DNA, 262 bp, Homo sapiens
tgctggtggtctgcatcaccaccggatcaacttcgacaaataccacccaggctactttgggaaggttggtatgaagcattaccacttaaagaggaacccagagcttctgcccaactgtcaaccttgacaaattgtggactttggtcagtgaaccagcacgggtgatgctgctaaaatcaggactggggctgctcccatcattgatggtggtcgatcgggctactacacagttctgggaatgggaaagctcccaaagcagcct

SEQ ID NO: 14520 - DNA, 184 bp, Homo sapiens
tattaaacaatgagctgaggctttattacagctggttttcaagttaaaattgttgaatactgatgtctttctcccacctacaacaaatattttagtctatttaaagtacaaaaaaagttctgcttaagaaaacattgcctacatgttctgtgattcttggcaagttttatatatattgtgtgcm

SEQ ID NO: 14521 - DNA, 203 bp, Homo sapiens
acacattctgaacttgctcctctgcgagcatctctggtgcccatggaacgctgcataacccgtttctttgaggagtgtgaccccaacaaggataaggcacatcaccctgaaggagtggggccacttcttttgcattaaagtagaggacatagatgaaaatctcttgttttgaaccgaggttttcaaggactctcactgtttcc

SEQ ID NO: 14522 - DNA, 254 bp, Homo sapiens
tttagtgactgacttggagctacccagtataaaaagcttttttacatagggccagaaaatagggggaatgaaaaggtgggagagaatttgtcaaaaaacaattagaggcaattgttaaagattgtagaagctgaagtagtggataacactggagcaaacaataggtgcatcataaagcttaaaagggaaaactgggggatgaaattctgtgggggctcccaaaagctccgtattaccggaggtctagagtaggk

SEQ ID NO: 14523 - DNA, 333 bp, Homo sapiens
cccgggagacgaatgaggaaccacttcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttagctgaaaaagatctgctagaagatgggtttggagagcaccccttttaccactgcctggttgcagaagtgccgaaagagcactggactccggaagacacagcattgttggttttgccatgtactattttacctatgaccc

SEQ ID NO: 14524 - DNA, 321 bp, Homo sapiens
tctggaggaaagacaattgttttctaaaattaaatttgtatggatagggatgcgatctgatagaacatggggaagatatatctgacaaaaggctgaagagtatatagcacaggatctaatttctcaatctgtagcatgtgctaaatatgagtattactagttgataaccagttttgtctaggccacagcataccatttgtaagcttggatgccttttcaggcctatcttcgcagtgaaatatgcttagctttcaaacactccgctcaaatcataatgggcatataaataatcacgctgttaaaacaattccacatatcctt

SEQ ID NO: 14525 - DNA, 412 bp, Homo sapiens
tcttagagggggggctgacgacagatgagggaggggaaactcttttttctatagacttcttttcagataacatcttctgagtcataaccagcctgtcagtatgatggcctatatgcagagaaaacaggctccttggtgaattgataagtaaaggcagaaaagattatatgtcatacctccattggggaataagcataaccctgagattcttactactgatgagaacattatctgcatatgccaaaaaaattttaagcaaatgaaagctaccaatttaaagttacggaatctaccattttaaagttaattgctcgtcaagctataaccacaaaaataatgaattgatgagaaatacaatgaagaggcaatgtccatctcaaaatactgcttttacaaaagcagaataaaagcc

SEQ ID NO: 14526 - DNA, 427 bp, Homo sapiens
tgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcacttgacaatcagacctatgctagttcctgtcatctattcgctactaaatgcagact

SEQ ID NO: 14527 - DNA, 218 bp, Homo sapiens
tctcactgagcaccgtcccagcatccggacaccacagcggcccttcgctccacgcagaaaaccacacttctcaaaccttcactcacaattccttccccaaaggcagaaagatgcacaaggggggacattgaggttgcctttgcttggggcaccccccagacaccattccttccaaggtccaccgtggattaaacattcacagagggggcccccctgcc

SEQ ID NO: 14528 - DNA, 199 bp, Homo sapiens
ctcggtttctcaatttcgagctggcaatccgccaaggacgacaagaagaagaaggacgcttgaaaggcggccaagaaagacaaagacccaagttaacaaatcccgggggcaaggccaaaaagaaggaggtggttccaaggcaaagtttgggacaagcttaattaccttggtttttttttacaaagcttcccttttataa

SEQ ID NO: 14529 - DNA, 304 bp, Homo sapiens
gaccctgttttgccctgctctgcaaccccttttccgtcggaccgtacaaacccacattatgatttacattccgtgtatggaaagacctcatgtcggcaaccgactgctattgttcatgtgctcttttccctctaacacgtcatacatttttaaccctgctaatcgtccttgaatcgccctctatttatattcaatgttctttctacctttttaaacgtctttttctcagggccccctttgtcttggcccaacatcggtctgacgttgctccgggggctttggtctccttctggtgggtgctctd

SEQ ID NO: 14530 - DNA, 313 bp, Homo sapiens
taacgagcaaaataaccagctaacatcataatgacaggatcaaattcacacataacaatattgactttaaatgtaaatgcactaaatgctccagttaaaagacacagactggcaaattggataaagagtcaagacccatcagtgtgctgtattcaggtaacccatctcacgtgcagagacacacataggctcaaaataaaaggatggaggaagatctaccaagcaaatggaaaacaaaaaaaaggcaggggttgcatgcctagtctctgataagtcagactttaaccaacatagttcaacagagacatagagg

SEQ ID NO: 14531 - DNA, 308 bp, Homo sapiens
tggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggcaggaggttgataaaatagcttgaggaaatagcctgaaaaacaaagatgagcttattttagtaacaaggtttttattttttattcctgtaaaatctttctaatctaaggccttggcaaagctaaaaattaaccgcacttttttctttgggccaatcagg

SEQ ID NO: 14532 - DNA, 226 bp, Homo sapiens
aagagtgagggttcaacttttctgcttatctgggaggtgttgggcgcggacagtcgagatgtcagagaaaaagcagccggtagacttaggtctgttagaggaagacgacgagtttgaagagttccctgccgaagacttggctggcttagatgaagatgaagatgcacatgtcttggaggataatttggatgatgacaatttaggagatgacctctcttatcaggta

SEQ ID NO: 14533 - DNA, 301 bp, Homo sapiens
aaaagatcatgttgggattaacttgcctttttccccaaaaaataaactctcaggcaagcatttctttaaagctattaagggagtatatacttgagtacttattgaaatggacagtaataagcaaatgttcttatagtgctacccgatttctatgaaatgtgtttgacaagccaaaattctgggatgtagaaatcttgaaagctcatttcctagggattcacttctgcagggattttttaaagtaatttcgggaaattaaccacagttcacatttattgtgagtgtctggctcacatgactc

SEQ ID NO: 14534 - DNA, 312 bp, Homo sapiens
gagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagaaatggagagctaaagtccagagaggatccgagacgctcttcagactgtacacgagctcaatacggagtctgttatgactacagactttgcgacgctacgccataggtg

SEQ ID NO: 14535 - DNA, 315 bp, Homo sapiens
cgagtggagagagcgagctgagtggttgtgtggtcgcgtctcggaaaccggtagcgcttgcagcatggctgaccaactgactgaagagcagattgcagaattcaaaggagctttttcactatttgacaaagatggtgatggaactataacaacaaaggaattgggaactgtaatgagatctcttgggcagaatcccacaggagcagagttacatgacaggattaatgaagtagatgctgattgtaatcgcacacattgactttcccgaatttctgacaatgatggcaggagaaatgagagacacagacagatgta

SEQ ID NO: 14536 - DNA, 287 bp, Homo sapiens
gcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagttccttcaacaagatcctctggaggcatcggtggtgttctggtgttcacaagggtttgtgtggggcagagccacaataw

SEQ ID NO: 14537 - DNA, 315 bp, Homo sapiens
aaaaaggcttcttattcgggtgtgagtcttttcagcaacccggtccagtactgggagatacagccatccaccttcagatgttctacgtgcgctctgccattcaactcggaaactataagtaattctcaagaaagccctcatttttataacctggcaaaatcttgttaatgtcattgctaaaaaataaataaaagctagatacttggaaccgtacttcatgtggatgtttacccgcatgacttattatgcatataagccaaatttcccgtgttcagkgaattggctacagtagaacagagagttttgtctgtcaca

SEQ ID NO: 14538 - DNA, 265 bp, Homo sapiens
aagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctaggaaggtattttttcacctcttaggtcatgtatgttttctctttgaagtactttgcatgttatgtttaataags

SEQ ID NO: 14539 - DNA, 212 bp, Homo sapiens
tgagtccatacagtaaagtaaaaggaagtattaagaaaatatcacaaggtcaggagtttgagaccagcctgatcaacatgtgtgaaaccccgtctctactaaaaacataaaaattagccaggctttgttgtgcacacctcttattccagctccttaggagacttaggcaaaagaatcccttgaacccaggaagcaaaagtttagtgtaggcc

SEQ ID NO: 14540 - DNA, 231 bp, Homo sapiens
ctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtggcttttatgaaaatatttgtaattaattatatatagttggagaatatgcacgtaaagcttttcccatatataaatatatatt

SEQ ID NO: 14541 - DNA, 235 bp, Homo sapiens
acacttcaattctaattgtttgcattgaagagggagaaaaacaaataaatcaagaatacctaatatctcaagtagaaggtcatcaggtttctctgaaaaatcttcctgaaataatgaatattacagaagtcaaaaaggtatataaactctcttcacaagaagaaagtatcgggacattattggatgctatcatttgtagagatgtcaacaaaaagagtgttttatgaaaatgtca

SEQ ID NO: 14542 - DNA, 167 bp, Homo sapiens
tccggcttcaaaccaaaccccttgcaccccacacagccggtttatacgacctcatttcgccaatatgggggaacaaccacattttcaacccaactggccataattaaatcccaaaaagacgtagggaagtccttatgtaccgggacacccggcaaccccgggaaacc

SEQ ID NO: 14543 - DNA, 225 bp, Homo sapiens
tattattacctaattattataaaaaatatggggtattgtggatataaaactgggggttattctaaaatttagttgaaaattattagaagcaaattaatcttttttttctaaaaaaaaaaaaatttaaaacttatcctggcaaagatcgcaaatactaaaactctaaatcttccctagcaaaaaaattatgacaaacgctcaattgctcttgtataaaaacattta

SEQ ID NO: 14544 - DNA, 238 bp, Homo sapiens
ctgttgcatgacttatgttaccatcctaaaaaacactatattaaacatggaataaattggtctttttatgaattaggctttttgaacatcctgtgttgggatttttttgttttttcaattggcaacaaaagctctttagggctgcagacattttaagttcacataatcatcttttaagacaatattgattttgtggggatactagaatttttttccccaaagtttccaatataaaggg

SEQ ID NO: 14545 - DNA, 234 bp, Homo sapiens
agttgccaaagaagatgtattatgaacaattcagcaataagacaattgtcaacacagttgagaataacaatggtaatcgttagtaatattaagccttggaatttgcctactgaaatagttataggtgattacttgtgatgtgaaactgaatttgagcatgacaaccaggacattttcagtttggtttgtaaggtttgaggatctaggaaaacttgggtttcttttcccaaaaga

SEQ ID NO: 14546 - DNA, 241 bp, Homo sapiens
acccagctgtgctgtcatgcagctaacctctgatgtggtcttcctcaccattggctatggatttgatttcaggtgtataggactaagggcagcttgcgggttagctctgtgactgcatagtttttctaccctctttccctgatcttttgctgccatttgatctttgatagttttggtgaaacctctctaaaatacaatcactttggggcccccggaatttattaaaattttgtactcaagg

SEQ ID NO: 14547 - DNA, 239 bp, Homo sapiens
ctgtttttactaggtgcaactgtgaaggaaaaactttcttctttaaggattctcagtactggcgttttaccaatgatataaaagatgcagggtaccccaaaccaattttcaaaggatttggaggaataacttgacaaatagtggcagccctttcaacaggctaaatataaggacttgccctaatctgtgtaatttttcaagggtaaggggcaacaattcagaaagatattattattaaa

SEQ ID NO: 14548 - DNA, 244 bp, Homo sapiens
cattaaactttgtcaataaccattaaaacataggcttaaattatcacgtattgttacaaagacacagttttgtctcattataaaataagattatatgaacatttatattctagaaatgattccaaatcatgtcctaagaatttctcccattcaaatgataatggaaattactgttcaaaaggcaaatttcaaagttaccccttacggtgttctctttgtaaaggaactaggcgtaaaggcattg

SEQ ID NO: 14549 - DNA, 307 bp, Homo sapiens
tcaacatgttgcaagagcacctgtttttacaagttaagattggacatttaaggacaaatatggttccagtagataacctaaagaactcggaacaattaggargagcaaactgtaaacccttgaaatctgtaattctttccttgatgactaagacgcaaaattggctctttggtttgtaattactgcagtgattctagaactaaatagatggtgctaagtttataaatcagtgcacacacatcgttattattgccaaaggatctcagtatatatttctacattccaaaattatgtcacaaaaggcagt

SEQ ID NO: 14550 - DNA, 286 bp, Homo sapiens
gtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgcttgtgacagcaaaaatgacccaccaatggtagcagctggcttcactgctcaggtgattattctgaaccatgcagggccaaataagcgccggctatagtccctgtatttgagttgtcacacggctcacattgcatgcr

SEQ ID NO: 14551 - DNA, 303 bp, Homo sapiens
tatgaggcagagaagagaaaggtgagaagaagagggagataaagatgatgagaaaagcccaagatcgaagatgtgggttcagatgaggaggatgacagcggtaaggataagaagaagaaaactaaggagatcaaagagaaatacattgatcaggaaggactaaacaagaccaagcctatttggaccagaaaccctgatgacatcacccaagaggagtatggagaattctacaagaggctcactaatgactgggaagaacacattggcagtcaagcacattttctgtagagaggtcagattgga

SEQ ID NO: 14552 - DNA, 293 bp, Homo sapiens
aatttaaactgaattttttgaccttggaaaatattttgcttactttaccaaggtgaagtttccttaattagactaattattttatccccatcccagggtataaacaggaattgttttgatagtggtggagttattcactgcaacaaaacaacaatgttgtccatgattcaaaatctaagcagtttcgattttgcctgtgaatatggtgtctgtcattcagggcatagctcactgttaggctagcctctgcttacttaaggctcttctcttacatactcaatggtggacatttd

SEQ ID NO: 14553 - DNA, 242 bp, Homo sapiens
atgacggctgctatatataagtgtttgtcatatgggtttaatcgtaagccatgatcataatgttaactaaataactttatgtggcactgcctagtaagggaactatggcaaggtttggatttctccaaatctggggggacttttcaaaatacgaaaataacctttatatgatatactatgactaggctgtctatttcttttcaggggatttttctaccttcagggggggggaggaggtcagg

SEQ ID NO: 14554 - DNA, 266 bp, Homo sapiens
tgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacctcccaatttacatactctgcttaggatttcgggggaaatcttagtaatataattga

SEQ ID NO: 14555 - DNA, 160 bp, Homo sapiens
gtaccatttatttaaagccatcaatttaatttctggtggtgcagaagttagaaggtaaagcttgagaagatgagggtgtttacgtagaccagaaccaatttagaagaatacttgaagctagaaggggaagttggttaagaatcacatcagatagctactw

SEQ ID NO: 14556 - DNA, 259 bp, Homo sapiens
aggccgggtggttgctgccgaaatgggcaagttcatgaaacctgggaaggtggtgcttgtcctggctggacgctacttcggacgcaaagctgtcatcgtgaagtacattgatgatggcacctcagatcgaccctacagccatgctcttgtggctggcattgacccctacccccgcaaagtgacaactcgccatcggcaagatagagagatcgccatagagatcaaagataaaatctattgtgaaagtgtatatctacac

SEQ ID NO: 14557 - DNA, 233 bp, Homo sapiens
gcacgattagcaagacggactaacgcagcctcctcctagtcctggcctccctagctctgtgctgctaagggacctcccccagagttccagattcttccgcaccagttattttaatccattttgatgtcagagacctgtgttggactctaggaaattcagaaggtaattgagtatgactcttttcccaataactggctgtgaaaaaacagaacagattgattttagcagaatgk

SEQ ID NO: 14558 - DNA, 230 bp, Homo sapiens
gagactagcctggcccacatggtgaaaccccgtctctgctaaaaatataaaacttagccgggcatggtggcgcgtgcctgtagtcccagctacttgggaggctaaggcaggagaatctctagaacctgggaggcgaaggttgcagtgagccaagactgcaccactgcactccagcttgggcgacggagggagactccatctcataaaaaaaaaaaaaaaaaaaaaaaaaa

SEQ ID NO: 14559 - DNA, 530 bp, Homo sapiens
gacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggtccatcactttggcaaagaatcaccccaccagtgcaggctgcctatcagaaagtggtggctggtgtggctaatgccctggcccacaagtatcactaagctcgcttcttgctgtccaatttctattaaaggtcc

SEQ ID NO: 14560 - DNA, 14 bp, Homo sapiens
gtgggctggggtag

SEQ ID NO: 14561 - DNA, 417 bp, Homo sapiens
atttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcaaactgtaaacaagaaaaaaaaaatcatgcattcttagcaaaattgcctagtatgttaatttgctcaaaatacaatgtttgattttatgcactttgtcgctattaacatccttttttttcatgtagatttcaataattgagtaattttagaagcattattttaggaatatatagttgtcacagtaaatatcttgttttttctatgtacattgtacaaatttttcattccttttgctctttgtgggt

SEQ ID NO: 14562 - DNA, 188 bp, Homo sapiens
aaggtgagtcttgactctttagtgtaggacaagattgtacactaacaccagcatggactgcttttcattgtgcgaaatgtgagccacgtaggttcggcctgctttgaagttaacattgccaggacgattcttctacagaaataatttcaatttttttccagtatttagtagtgaaagctattaataca

SEQ ID NO: 14563 - DNA, 313 bp, Homo sapiens
tcacaatggagctctcggagtctgtgcagaaaggcttccagatgctggcggatccccgctccttcgactccaacgccttaacgcttctcctccgggcggcattccagagtctgctggacgcccaggcggacgaggccgttttagatcatccagacttgaaacatatcgacccagtggttttaaaacattgtcatgcagcagctgcaacttacatactagaggcaggaaagcaccgagctgacaggtcaactctaagcacttatctagaggactgtaaatttgacagagagcgaatagaactgttttgcacgga

SEQ ID NO: 14564 - DNA, 314 bp, Homo sapiens
tgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacccgccgccccactcttaatcagtggtggaagaacggtctcagaactgtttgtttcaattggccatttaagtttagtagtaaaagactggttaatgataacaatgcatcgtaaaaccttcagaaggagaggagaatgttttt

SEQ ID NO: 14565 - DNA, 313 bp, Homo sapiens
cgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaacggagataatattactctgctacaaagtgtctccaactagaaatgatcaatgaagtgagaaattgttgagagggtaca

SEQ ID NO: 14566 - DNA, 229 bp, Homo sapiens
gttaaagtgagtatactgtggagaggacttccaaatgtggttacctcagctatatcactgcccaacatcagaaaacctgacagctatgattactatgccttttctaaagatcaatactataacattgatgtgcctagtagaacagcaagagcaattactactcgttctgggcagaccttatccaaagtctgtacaactgtccttagactgatgagcaaaggaggagtca

SEQ ID NO: 14567 - DNA, 212 bp, Homo sapiens
ggcattatattttcatctgatcctcactgccctctctctgctgtggggggatattttactggtccatgaaatccaagtctgggaaccactgaagtaagtgatctcaatggttatttcataatcattctatgtaaatctacccaattaacagattttgcaacggcttttaattgtatagagccaggaccctaaaaaaaaaaaaaaaaaaaaaa

SEQ ID NO: 14568 - DNA, 314 bp, Homo sapiens
accaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaccgtgtttggcagctggatcatt

SEQ ID NO: 14569 - DNA, 194 bp, Homo sapiens
aaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaacataaaatataact

SEQ ID NO: 14570 - DNA, 214 bp, Homo sapiens
tttggagggaaccgcagataagtttttttctctttgaaagatagagattaatacaactacttaaaaaatatagtcaataggttactaagatattgcttagcgttaagtttttaacgtaattttaatagcttaagagtttaaagagaaaatatgaagacttagaagagtagcatgaggaaggaaagggataaaagggttctaaaacatgacggaa

SEQ ID NO: 14571 - DNA, 250 bp, Homo sapiens
acggagagcgtagtgaccatcatgagcctcctcaacaagcccaagagtgagatgaccccagaggagctgcagaagcgagaggaggaggaatttaacaccggtccactctcctgtgctcacacagtcagtcaagaacaatacccaagtgctcatcaactgcccgcaacaataagaaacttcttgggccgcgtgtaaggcccttcgataggcacttccaacatggtgcttgagaacgtgtaaggagattttg

SEQ ID NO: 14572 - DNA, 236 bp, Homo sapiens
tccttaccagtgacttgtccattggttccaattcctagctgcgaaactccaaaacttgctacaaagaccagttcaggtcaaaaaagtatgcatgaatcaaaaacatcaaggcaaattaaggaatcaagatcacagaaaacacacacggatactgtaaggaggtagttactgtaaaccctgaaggaaacacagatattaccgcggactcctgaaatgttttcactgcatgcagccag

SEQ ID NO: 14573 - DNA, 230 bp, Homo sapiens
aaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctcgtgatagctggttgtccaagat

SEQ ID NO: 14574 - DNA, 181 bp, Homo sapiens
tcaaacgttagctagcacaccccacggaaacagcagtgattaacctttaggaataaacggaagtttaactaagctatactaaccccagggttggtcaatttcgtgccagccaccggggtcacacggttaacccaagtcaatagaggccggcgtaaggggtgttttggatcaccccctcccc

SEQ ID NO: 14575 - DNA, 255 bp, Homo sapiens
ccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctcaaagttcttatgagattgtccaaaacaaagaaacatgtcagca

SEQ ID NO: 14576 - DNA, 220 bp, Homo sapiens
tgtacggtaaatacgggacccgttatggggcctccctcccggaaaattggtgaagaaaattgaaatcagccagcacggcaagtacacttgctctttctgtggcaaaaccaagatgaagagacgagctgtggggatctggcactgtggttcctgcatgaagacagtggctggcggtgctggacgtacaataacacttccgctttcacggtaaagtccgcca

SEQ ID NO: 14577 - DNA, 211 bp, Homo sapiens
gcatttggaagctgaggcaggcggaattttaaaggcccaggaggcaagaccagcccgggcaacaaaggctaagacctgctctaaaaaagggccttttaaaaaagtcgggaaagggggggagcacccgggtgccccattcccccggaggcccaggcaggaggagcgtaaagatcccagaagggggaggcaacagatgagacaaggacacacc

SEQ ID NO: 14578 - DNA, 203 bp, Homo sapiens
atctacgggatgccgtccgctaaaacgccggcgagagcttttcccctgcggttagagcgcagagacgaggcataacccggggccctgtttaaaggttatccaagtccaagggactgaagggagaagtgaaaaacaaagtaaaaattttataagaaggtggaaacaaaaacaggttcagctgggcgccaacagataaaaaaata

SEQ ID NO: 14579 - DNA, 214 bp, Homo sapiens
tgcaggttaatgaatttttacaaaatgagcatgcccatgtaactgtttcttctgatgatctagaaacagaatattgaggcacccacaaaaccacccttgtccctacaacccttgtccctttccagtgctcctttccacccttcccctttactgccttttaccaggggaaccactctcctgacttctgacaggtcagattagttttgaactggaa

SEQ ID NO: 14580 - DNA, 243 bp, Homo sapiens
  misc_feature 213: n = A,T,C or G
atatttgttcaaagattctatttcataatatgcttttagtatgagagacatataaataattgtggagaaatataaatttgttttttgttcctgctaaagttgtagagatacatttctaattagtattctcaatataacataagctactcacatgtcacaattgtaataaaatattataccattcatttgacctaattcttcagacaatgatcnacatcctcttatgaaaaatcattatttata

SEQ ID NO: 14581 - DNA, 215 bp, Homo sapiens
atcagcaagtgtcttatacaacaagcaaatttgttcaaagagaagcattgcaaataagtatttataattgtataggtttatatttttgccagaagggttggatccccttagcaattggggaaaataaaagaatttttaattacaattttcaggttattcccttttcccaaggcaaatttatttaggggagagactctatatccccttaaatattt

SEQ ID NO: 14582 - DNA, 140 bp, Homo sapiens
tcaacaataaaaaccaaattatggggctgcttttgtcacactagcatagagaatgtgttgaaatttaactttgtaagcttgtatgtgggtgttgatcttttttttccttacaggcaccaattattaaatttcatattaaa

SEQ ID NO: 14583 - DNA, 253 bp, Homo sapiens
accccgacagccgttacatccttgctaaggcccactccggctacagctcttgctgtcagatacgaatcccaagaagtcgggtggtagctccaaaaaccccggtgggaaagtcataaagaagacggccaggcattaaggaaattggaggtcaatatttgttcatctctgggacacaaaaattcacacacacacgcgcaatttccctctgcacacccagggtccccaagtttgggggttttgggagcgtataata

SEQ ID NO: 14584 - DNA, 237 bp, Homo sapiens
taaatttaaacctggaaaagtaggaagcagaagaaaaaagacaagctaggaaacaaaaagctaagggcaaaatgtacaaacttagaagaaaattggaagatagaaacaagatagaaaatgaaaatattgtcaaggggttcagatagaaaatgaaaaacaagcttaggcaagaattttgaggaatatgggaggtagagaaaatatataagccacaaatttggagtataaatagcactc

SEQ ID NO: 14585 - DNA, 215 bp, Homo sapiens
ttctgctgagggggcaggcggagttgaggaaaccgcagataagtttttttctctttgaaagatagagattaatacaactacttaaaaaatatagtcaataggttactaagatattgcttagcgttaaggttttaacgtaattttaatagcttaagattttaagagaaaatatgaagacttagaagagtagcatgagagaaggaaaagataaaagg

SEQ ID NO: 14586 - DNA, 228 bp, Homo sapiens
aatgtataactataaatgtctatattgaaaaaggaaaaatatcttaattacctagctgtgatagggtgacaaaagtttcttcaaaaggtattcatgtttccatcccttggacttgggaaatattttattttgaaaaaaggctttttgcaaattttaattagtgtaagggttttgagatgatgtggggtatctccctgagatatatcagagtgagaccctaaaaattaa

SEQ ID NO: 14587 - DNA, 221 bp, Homo sapiens
tcctgctgtgccagaaacccttaagaaaaagcgaaggaatttcgcagagctgaagatcaagcgccttaagaaagaagtttgcccaaaagatgcttcgaaaggcagggaggaagcttatctattaaaaagcaaagcacctttcacaagggatatgggaagagtgttacaaagacctaaattcggattgcgcgagatatgaaaagaaagcttgcaacttctat

SEQ ID NO: 14588 - DNA, 211 bp, Homo sapiens
cgcagtggctcacacctgtaatcccaacactttgggaggcttgagtcaggcggatcacaaggttcaagagatcggagagcattccctggccaacatggtgaaaccctgttctctactaaaaatataaaaaaattagccgggtattgtttgcatgcggctttggggccagctatttcgggagtctgaggcaggagactcaaattaacccaag

SEQ ID NO: 14589 - DNA, 172 bp, Homo sapiens
ctgccacaccccacgggaaacagcaggtaataacccttagcaaaaaacgaaaggttaacctagctttccctaccccaggggtggggtaaattgggcccccaccaccccgggtaaaagaataacccaaggaaattgaagcccgcgcaaagaggttttggaaaacccccctccc

SEQ ID NO: 14590 - DNA, 400 bp, Homo sapiens
ggagccgagccggactggtcaggatgatcacggacgcgcagtcgccatctttcgccaacatgctgggcgtgtcgctctttcttgcttgtcgttctctatcactacgtggccgtcaacaatcccaagaagcaggaatgaaagtggcgctttctccgccccagggttccaggacatagtctgaggcaagatggagggtattaggggccttcacacttcacttcatcccttctacccatcacaacatacaaagcacctacacctcgagttttccaaacaccttttatttcctcagagtccttccttaatccaatggaccaagaagctgccactaaatagggcccgtataggggctggctttttttctccctcccccaatataaaatatagactttttaaaaaa

SEQ ID NO: 14591 - DNA, 258 bp, Homo sapiens
aatcttagaagaaaaccaggaaacattctgtacatcagttttgggaagtaattttatgatgaagttacaaaagcaattgcaacaaaaataaaaattggacaagttggacttaatttatactaaagagccttctgcacataggaactatcaacagagttaaacagttagcccacagagattggaggaagtatttttcaaactatgtcatctgacaaaggtcttatatacagaatctatataggacctcacacactttag

SEQ ID NO: 14592 - DNA, 301 bp, Homo sapiens
ccatttttgccttagacagtcagcatttgtctcctcctttaactgagtcatcatcttagtccaactaatgcagtcgatacaatgcgtagatagaagaagccccacgggagccaggatgggacttgtcgtgtttgtccttttctccaagttagcaccccaaggtcaatgcacacagagcccccggggtggtgagcgctctgcttctcaaaccggcccaagggtgcctctctttagggatctctctcgggttttggggcccgctgtctctctgggtgggcaatataagagctcttcacacaca

SEQ ID NO: 14593 - DNA, 410 bp, Homo sapiens
ccaatatatgcaatggtaagccagtagatggactgactactttgcgcaatgggacattagttgcattccgaggtcattatttctggatgctaagtccattcagtccaccatcttcagctcgcagattacttaaggttgtggtattccttccccaattgatactgtttttaactaggggcaactctttaaggaaaaactctcttctttaagggttttcacaaacaagcgcgttatccccatgatataaaagaggcaggggaccccacaaccacatttcacagggtattgagacccccccgacacatagtggcgcagctctcacagcatcaatatatgatgctcgctcctgctctatatataatgacgagagggcggcagcctcagagtattatatcacagccccccagcag

SEQ ID NO: 14594 - DNA, 291 bp, Homo sapiens
ctaatcagatgcaacggcccaaattcttgatctgcagcttctctgaagtttggaaaagaaaccttcctttctggagtttgcagagtttagcaatatgatagggaacaaggtgctgatgggcccaagagtaacaagcatacaaaactacttattatctgtagaaggtttgctttgttgtatctgaggcctctatgtaaagggttaaatatgtaacgcgattcatgtatatccagtgttcagtatatagcggctatgtgtgtgcaaaataaaagatatttttcagagagagga

SEQ ID NO: 14595 - DNA, 477 bp, Homo sapiens
cgctttgaacgtgctataggaccttctcaaacacacaccatcagaattcaatattcacctgccagactggctcatcaagacaaaggtgtccttcataatgaagttaaagtgagtatactgtggagaggacttccaaatgtgggtacctcagctatatcactgccccacatcagaaaaacctgacgggctatatataaactcatagccctctctaaaagagtcaatatctttatacacatgagtgtgtcctagatgagagccacgcgaggagcacatttcctcactcggcgtctcgggcagagcctctatacacaagggcttcgtgccacttcttcccccgactgcatgagcagcaggggggagtgcaactactattagaggatgaactaatatatattttatcaactataaaaacattttatttaataggggaggtattctcactgcagaaagaaaaacaaaaaaaaaaaacaaaaa

SEQ ID NO: 14596 - DNA, 451 bp, Homo sapiens
caccctgaagatgcatattcggacccacacattaccttgtgtttgcaagatctgcggcaaggcgtttttcagaccctgggttgcttcaaggacacattagaactcacgcgggggagaaggcctttttcttgccctcactgcaacagagcatttgcaggcaggtcaaatcttagggctcatcttcagagcccttctctatgtgaaagggatatccctttcacaaactttctccccaaaccttttccagagtgtgtctgccgcacacacatttggagtctcgtctcctgtgtagcgcactctgggacgcgtaactttgtactcgtgcagcagagcaccatcacactctgtgtgaaatggtcacagaggagcaccagcagttctcctgctgctgccgcgcaccaaatgggagggggagccccacatatcctcccacccacaaagcaccaccgcg

SEQ ID NO: 14597 - DNA, 267 bp, Homo sapiens
caaatcttgttaatgtcattgctaaaataatcaagctagatactggaacctaactgcaatgtggatgttttacccacatgacttattatgcataaagccaaatttccagtttaagtaattgcctacaataaaaagaaattttgcctgccattttcagaatcatcttttgaggctttctgttgatgttaactgagctactagagatattcttatttccctaaatgtaaaattttgagtaaatatatatgtcactatttagtaaagcty

SEQ ID NO: 14598 - DNA, 261 bp, Homo sapiens
ttaatactaagtcactattttctcatctattacttggaagtaatacctatcccgaaaattgttctattacatgttataatgaataaacagcctcatttaaagccagaaaccatactaggtggtcaataaatgatatgtatcctagtaattctcttattaaaacaaaatttatttcatatatatcagctgtaaattttacatccctagattagtagtttaaaaacatttgttgctataggagatttatgtaataataatcts

SEQ ID NO: 14599 - DNA, 306 bp, Homo sapiens
gcagggtccgagggctgtgtcagagggctgggcagcsatggcgtcctatttcgatgagcacgactgcgagccgtcggaccctgagcaggagacgcgaaccaacatgcttcttgagctcgcaaggtcacttttcaataggatggactttgaagacttggggttggtagtagattgggaccaccacctgcctccaccagctgccaagactgtggttgagacctccccaggacagtcatcagaggctctcagactgagctcaagtgccccgtgtgtctttgggaatttgaggaggaggagactcccatt

SEQ ID NO: 14600 - DNA, 308 bp, Homo sapiens
tcagttagcacatcatagaggagccaaagtgatttcavcagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgacccagctgtaaaactacaactactaccacataaacatgatatcatcacacttcttggggttggaggccactgggtaacaacagaagaaaacc

SEQ ID NO: 14601 - DNA, 238 bp, Homo sapiens
ttgaggcagccagcgcaggggcttctgctgagggggcaggcggagtttgagggaatccgcagataagtttttttctctttgaaagatagagattaatacaactacttaaaaaatatagtcaatagggtactaagatattgcttagcgttaaggttttaacgtaattttaatagcttaagattttaagagaaatatgaagacttagaagagtagcaaaaaaaaaaaaaaaaaaaaaaac

SEQ ID NO: 14602 - DNA, 309 bp, Homo sapiens
  misc_feature 35: n = A,T,C or G
taataaatgccctcagacttcaggaaagttcagtngagagggccatgatgtttggagactacttcatagagaaaggaaaactttggacttgggaattgaagggaggagttagaaccatagacaaatttgaaagacacagatccaatccagggaggatgcactaagaaagaaaagttagatttactctaggagtgatagattagtttgatgaggcattctctcagtgggagtagaaaaaatgaaatcggggaactagatagtgagggagatggtagagactgtccagtctgggataagacgttggactat

SEQ ID NO: 14603 - DNA, 300 bp, Homo sapiens
ggttgggacaaagccatctgggcagtcaggggcaaggctgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgcccctgccccagggctcttcagaaagcatctgcatgtgaacacatcatgctttataaaggatctt

SEQ ID NO: 14604 - DNA, 309 bp, Homo sapiens
aaagattatatattatttctgaatcgagatgtccatagtcaaatttgtaaatcttattcttttgtaatatttatttatatttatttatgacagtgaacattctgattttacatgtaaaacaggaaaagttgaagaggatatgtgaaggaaaatgtatttttcctaaatagaaataaatgatcccattttttggtatcatgtagtatgtgaaatttattcttaaacgtgactactttatttctaaataggagattycctacctgcttcctacaagcagttcagactgccatgccttgggtggtcctagtg

SEQ ID NO: 14605 - DNA, 302 bp, Homo sapiens
ggactctttggccatcctgtcagagatgggagaagbcacagacggaatgatggatacaaagatggttcactttcttacacactatgctgacaagattgaatctgttcatttttcagaccagttctctggtcctaaaattatgcaagaggaaggtcagcctttaaagctacctgacactaagaggacactgttgtttacatttaatgtgcctggctcaggtaacacttacccaacggatatggaggcactgctacccctgatgaacatggtgatttattctattgataaggccaaaaggttcg

SEQ ID NO: 14606 - DNA, 304 bp, Homo sapiens
  misc_feature 35: n = A,T,C or G
tacatacttattccatttttaagcatttgcttctnttttccctacctagaatgtcagatgtttttcagttatctccccatttgtcaaagttgaccycaagataacatttttcattaaagcatctdagatctaagaccacaattattatcgtaacaatgattattagctcatccacttattttgatactaatgatcacagctattatactactgtctcgttattttgtgtgcatgcctcatttccctgactcaaacctcactgagagcgcaaaatgcagctttatactctaactttcaattgcct

SEQ ID NO: 14607 - DNA, 111 bp, Homo sapiens
atattaaaaggtaatagatttcacaagtatttattttatgttttataaaactacaaacttagaaatatacattaaaaatcaatactatatgaaaagggaaaaaaaaaaaaa

SEQ ID NO: 14608 - DNA, 199 bp, Homo sapiens
attcttgtcaggattcaataaggaattgcatatgaaatgcttagtgctgtatctggtacataagcattcaaaggaagtgcttgggctcaggtctgtgggaatctgaagcttctgttttctggatcatagcttcattattagcaaaattagacaataatctgctattcacttgaatgtgtcccttcaatagtccatatgg

SEQ ID NO: 14609 - DNA, 212 bp, Homo sapiens
tcctttgccaagaccaaaaggaagaagaaaagggccaaaagccaaaatgaaacttatgggtacttgttttaaccattgggctaactttgctgtctaggaggttcaaggcaatgcctgcaaaatcggcctctcttggctaaagaaaggtactaaaaggtcaaaactgtcccaaccytcccggagggggtaggtttacccaaaaaaggtttgat

SEQ ID NO: 14610 - DNA, 221 bp, Homo sapiens
cataggaagaagcacccagatgcttcagtcaacttctcagagttttctaagaagttctcagagaggtggaagaccatgtctgctaaagagaaaggaaaatttgaagatatggcaaaagcggacaaggcccccttatgaaagagaaatgaaaacctatatccctcccaaaggggagacaaaaaagaagttcaaggatccctttgcaccccagagggctcctt

SEQ ID NO: 14611 - DNA, 206 bp, Homo sapiens
tacgtatgagttcctattttttcctcctcctttaattttttatcttaatacccattttacttctgaaataattcatctgttttgctttatgaccagctttaatttcaattgggggataataacaaccctaggggttcataggaaagggcattaaaatacattttttgcataaggatacctaaaaccatctacccagcttgggggtg

SEQ ID NO: 14612 - DNA, 175 bp, Homo sapiens
agaagcaatgcgagatcccggaagtaggccgaagtataaaaccccaaatcaagaggtaaagctgggcccttggtttctcaagttgcccacttggccctcttccaagtgtacttttcttcctttccttactgttttaaagctttttaataaacttccactcctgctctggaaaaca

SEQ ID NO: 14613 - DNA, 228 bp, Homo sapiens
actagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggggatgacatttctgattttcagaaattaacataaaatccc

SEQ ID NO: 14614 - DNA, 135 bp, Homo sapiens
aggaaggctaaactagtggctgttgaatatcaattagaattctagaatctttaggcttttaggtgtttttttgtacaaaatgtggggcttctttcctttttcaaccaaggagggtttataggccccttaaacccc

SEQ ID NO: 14615 - DNA, 111 bp, Homo sapiens
gggggaagaatttgttccccggggggggaagttattttctgggggggggggaaagggtccatttttacgggattccttgggggggggaaagggaaaaataaacctttaagg

SEQ ID NO: 14616 - DNA, 128 bp, Homo sapiens
ggggggtggaaggggggggttctggttcctaataaaaaaggggttaaaaacccaaaacccaaacctgggaaattgggaaaaacctttggaaaaaccaatttaccttgggggggggaaatttaaatttt

SEQ ID NO: 14617 - DNA, 120 bp, Homo sapiens
ccccctttaaaggtttaagggttaaccccgggtgtcaaggggaattaaaaccccaaaaacggccggccccttcccttttaaaaaagcggtttaaaaaccccccggggcctttaaaaccgg

SEQ ID NO: 14618 - DNA, 112 bp, Homo sapiens
taaaagggaaaaaacccaaagcccttttcttttaaaaaaaaaatttgttaaaaaacttttgggaagtaaaaccccccaggggaaaaaggggaaggtatttgttggccccttc

SEQ ID NO: 14619 - DNA, 111 bp, Homo sapiens
tgggcaattgttgaacggacgggtaaagggaagccagggttttaacaaaaacttgggccaaggaagggggcctttaaccttcccttcaaaaagggtcggggggttaaattc

SEQ ID NO: 14620 - DNA, 131 bp, Homo sapiens
ttttcttttgaaaagaattcattaaataataggaaaaggcaatctaaagcaaaggggtagccaaaaaaattaaaaaaaagggaaaaaaagaaaaaaaggggggggcccccaaaaggtttacaaaattttta

SEQ ID NO: 14621 - DNA, 144 bp, Homo sapiens
aaggttccggttgaaggttttaaagtttaatttaacttgaaggaaagggaaaatttggttaaatttgaattttaggtttttggccttcctttttaatttttcccattgttttgtttaaaggtctttccgtttgtttccccccgt

SEQ ID NO: 14622 - DNA, 130 bp, Homo sapiens
taaagttaaatctttcctttcctttaaggccttttttggagttaggctttgggattttcaagggcattttacccacccacaaccccagctttaatttttggttttttttttgttaaggaaggcaagggtt

SEQ ID NO: 14623 - DNA, 115 bp, Homo sapiens
aaaaaaaaatttttggggcctccttttttcccccaaatttttttttttttggggttttggggaaatttttttttaattttggggcccaattttttgggtttttttttttgggcat

SEQ ID NO: 14624 - DNA, 303 bp, Homo sapiens
agaatgaggtgaccaaagtgcgaaaagttactttcgatggactgaaccagatgattgtcatagaactgggcaccaatccgctgaagagctcaggaattaaaaatgggggctttccagggaatgaagaggcttttctacatccgcattttctgataccaaatatcaccagcatttctcaaggtttttctccttcccttacgggttacatctttatggcaacaaaatcagcagagtttatgcagctagccttaaagggcttttttatttttgctaggttgggggtgggtttcaacagcatttctg

SEQ ID NO: 14625 - DNA, 113 bp, Homo sapiens
aaatgttaacactggtagtatagggttgatttttggggaatatttatttatttgcaatttttcttgggacacttttatataggtcatcacaaagaaggaaaaaaaaaaatggg

SEQ ID NO: 14626 - DNA, 163 bp, Homo sapiens
acttgaggatttaaacgtacaggactacaaaggctggcctgggaaacaacaaatcacagtttctgaaatgggacgcttctaacacacagggtgggcgaatcattgggcacaatccctaaaaagaccccttaggccccaagtttaacaccccaaaaaatttcct

SEQ ID NO: 14627 - DNA, 204 bp, Homo sapiens
atctagacttgctttgtatctagcgttatgaccataggcaaagctataaaatttcataaaaatttcttttgtttaaattttccacaccttttaaagcgggactttaacttagagagttgttttgagagggaaaatttaaaatttttttttaaaagggtttttttagttttgatccccacaatcccgaaaattttttttaaaaaa

SEQ ID NO: 14628 - DNA, 200 bp, Homo sapiens
actttctcttaaaacagaatgtgtgagcagcattgtcaatgtctacgtagcacgtttacctcataatgttgtgttttaatgcttacttgagagtcttgtatatgaaaggcaacctgttgaattataaaactcataatgagggtattaatgcccttattaaaaagtattacaaaagccttggaaatattaggggttcattt

SEQ ID NO: 14629 - DNA, 211 bp, Homo sapiens
aaccatacctctgttaaatcaaaatgaaaacaaagcaaatgaatactggacagtcttaacaattttataagttataaaatgactttagagcaccctccttcattacttttgcaaaaacatactgactcagggctctttggttctttttggcatatgacaacttttactagaaatacaagctacttggtttgcatagaacattcatctttaa

SEQ ID NO: 14630 - DNA, 203 bp, Homo sapiens
ccacatgagactggtggttacatgttagagtgtgtgtgtcttggtaatggaaaaggagaattgggccttcaagcccataggttttttagtcttagggcttagcaagaccttggattcttagtttctaattttgggttgggccccaaatcacatctacataggtcatagaccttaatttcagtgtaaaccaataaagaaattgg

SEQ ID NO: 14631 - DNA, 118 bp, Homo sapiens
tatatatgaacaaaaaattttctttatgctctcaaagtccgagactcttaaggaaaaaaatttaagggcataaccaaattctataatatcgggaaatcttttaccaattaaggaaggc

SEQ ID NO: 14632 - DNA, 216 bp, Homo sapiens
gtggttcgtactcaagtgatctattatctagctgcaaaggctggcttcgatttgaaattttgtaaaaatttcatggcacccaaggtttctgattcttacccaacagtgggcccccaagagagcttatggcaagtcttttaggcaatttgaatttaatttaagggtgagcatataccctttgaaccagcacataccctttttcacaagcgagtgtat

SEQ ID NO: 14633 - DNA, 204 bp, Homo sapiens
ctgtttattgcttgtctcccctcaaccccaattctttaaaggcaggggtttctgtcttattattatatcaccagcacccagaacactgcctttcacataaaagatgctccatgcatacaaactgattcatttactkacaccccagatctccaaaatacactattagttcccttgttggcagaggggattttcttttttgggcca

SEQ ID NO: 14634 - DNA, 275 bp, Homo sapiens
tatacatgccacaattactttgttcatttatgggtggatatttagagtatttctggctagagttctggagctaatacaaataaagcagttatgatcatttgtgttcaagcctttgtaaggaaaaatgcttttatttctcttgggtaattacctaagaatggaatgactgggatcatatggtagatggttgtttaacttttaacagcagccatgttgttttccaaagtagttgtgccattttacattccaaccagcagtacaattttcttttcttg

SEQ ID NO: 14635 - DNA, 262 bp, Homo sapiens
  misc_feature 37: n = A,T,C or G
ctggtcttgacttgtcatattcccccatgcaatcctnggtctgtattgctcaattttaggaagcctttgctactccatcagtaggtttagatttgagcttttgagacctggctatggaaaagaaagacacttgagaatttagtgttggggcctgttcagatgatgctacccaatttggctttaaggatcaagtacaggttgaaaactatttttataaaggtaatacttttctagtgtcccgtcttccctccctctaaatcta

SEQ ID NO: 14636 - DNA, 283 bp, Homo sapiens
taaaaccagtttgcaggtgcacaaactatgagggacttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgattttttaaataggattttgcacataaatacattgtaatactgtatgataatcatgtgtggaaaataattttgacataaaataaag

SEQ ID NO: 14637 - DNA, 237 bp, Homo sapiens
gctgcccgggaaatgctgcgaggagtgggtgtgtgacgagcccaaggaccaaaccgtggttgggcctgcctcgcggcttaccgactggaagacacgtttggcccagaacccaactatgattagagccaactgcctggtacagaaccacagagtggagcgccttttccaagacctgttggattggcatctccacccgggttaccaattaacaccgacctcttgtaggcgtagagaagc

SEQ ID NO: 14638 - DNA, 250 bp, Homo sapiens
ttagaaacacatctgttgtctttcctgtgtttggtcgatattaataatggcaaaatttttgcctatctagtatcttcaaattgtagtctttgtaacaaccaaataaccttttgtggtcactttaaaattaatatttggtaaacagaatccatgtacctttttctaaggttagaatgaataattaattgtatgggggttttgaatgtttgtgctttttaaatgagccaagactagaggggaaactatcacc

SEQ ID NO: 14639 - DNA, 279 bp, Homo sapiens
acttccaaatgtggttacctccagctatatcactgcccaacatcagaaaacctgaccggctattattacctatgccctttccttaaagagccaatacctataaccattgattgtgcccaagtagagacagccaagaggaaattacctactctgttctgggggagacccctatcccaaagtgtttgtacaactgtcccctagagtttatgagcaaaggagggggttcactcaatgaaggaaatgtatatatatttttgacacttctaaaacaatttattt

SEQ ID NO: 14640 - DNA, 210 bp, Homo sapiens
attggatacttcagtcttaggtgtctgatcatactaacaatctatacctgaaattaaattactaattttgcttcaggatagcccctagggaatgggcctgtattttgaaaaaatccaaatttcttaaaaaaaattaattaacccctttgaaaaacccccctttttttggttgggtctttaggagccttggggggaaaaaaccaaaaaaag

SEQ ID NO: 14641 - DNA, 134 bp, Homo sapiens
cctgtaatctcagctacttgggaggctgagttgggaggatatcttgagcccaggaggccgagggttgcaggtaagcccaagatcggtgccaaatgcaattcaggcctagggaataaaaaaccctgtcttaaggg

SEQ ID NO: 14642 - DNA, 132 bp, Homo sapiens
acttacatgtccatctttaatgggctatttcacaatgaggccatcaacattcccaatctaatgcgacacccagcaaccactcaaaccattcatttcattctatttcgggaacccacctcctcccaaaagcac

SEQ ID NO: 14643 - DNA, 424 bp, Homo sapiens
gttttctctttgaaagatagagattaatacaactacttaaaaaatatagtcaataggttactaagatattgcttagcgctaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagttagtttaaaagttgtaggtgattaaaataatttgaaggcgatcttttaaaaagagattaaaccgaagtgattaaaagaccttgaaatccatgacgca

SEQ ID NO: 14644 - DNA, 528 bp, Homo sapiens
ttagaaaagggtattatttagctagatcaacttgggtttaaaataagaaatagagcaatagcgcgtccatagcaggaaatgtagacacaaagaaacgtcactattgtacctgaacatgagaatgtttttattttatttcctacgacaatgtaccttttgtactttcttctctacaaatatattaaaagctgagctgaggagtgacttggtaaataaagacaaagagaaaatacagaggtagtatttatgaaagattggaatataaattgcacaaagcaagtatctaaaagtgttagtttcagaaaggtaattttagcataaacatagaaccactaagatgcattgatgtttacatacacaagattctttgacatgtactttgaatatacaaaactataaatagactcacttttattgagaatttgctatgacaaggaacatttatttaataactgcaatgatgggagaagatgcatcaagggaggtaatttatggattttggagtaaggcaatggatcttaatcaccc

SEQ ID NO: 14645 - DNA, 338 bp, Homo sapiens
tgaaatgtgaccttttaacatactgtttttaaaaattaaaaatgtatgtatagggtttgaaaacttgttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatccttaaaaaaaaaaaaa

SEQ ID NO: 14646 - DNA, 680 bp, Homo sapiens
caccaaggaagggaattgtttatttatcgagaatatttgttcaaagattctatttcataatatgcttttagtatgaaagacatataaataattgtggagaaatataaatttgttttttgttcctgctaaagttgtagagatacatttctaattagtattctcaatataaaataagctactcaaatgtcacaattgtaataaaatattataccattcatttgaactaattcttcagacaatgatcacatccttttatgaaaatcattattaatatagtctttgaaatgtgatgtatgacatatcttaaatgactaaatgacacataatgaaaacttaaggatattaaaataacaagtcatatttattctttttagtaaataaatttgttgaactgtggaaagagaaggtttgcttggtttaaggacctgggtaataatattacttcttaagattattttttggatggggggaaaatgaatggaataaaccttcccaagaagaaaggaccacccgccgggaaattttaaaccacatcaagaggtgggggacataggacctggattccccatggaaagagaagaggacctttgcctcaccagactgcccagcgggggagggagactccctggggcatggaggccgggccttcggaggagccctgctctttgctgggccccgcc

SEQ ID NO: 14647 - DNA, 179 bp, Homo sapiens
cacttttgagacttttttggtggatgtaaataaccccattctttgcttgaacacagtattttcccaatagcactttcattgccagtgtctttctttgggggcccttccttgttcagcattcttagcctgtggcagtaaagaggaaactttgtgcctacatggcgacaaagctgtctaaa

SEQ ID NO: 14648 - DNA, 179 bp, Homo sapiens
tctcttcatgtatctcctaatgccttacactacttggtttctgatttgctctatttcagcagatcttttctacctacttttgtgtgatcaaaaaaggagagttaaaacaacaccatgtaaatcccttttgatatttcaaggggattcctctcatttaaaaataggattaagcattttgt

SEQ ID NO: 14649 - DNA, 152 bp, Homo sapiens
tctaattatatcaatttatgagagaagtatttcctaattatggcacaataaatttggtaacatcctagtgattctctttctatataataaggcaattacagttttacaaagcattaagtcttaacataactttaaaacattctcttgggttt

SEQ ID NO: 14650 - DNA, 246 bp, Homo sapiens
gttccttgtgaccaatggggaagtgggcttgaagcttcccatgcctccagataaattcaacttcctggtgtggtgtcaaagccctttcatacccgcctttgtgtccctttaamaaattttttgtgccaacccatggtttgtttttgccttgaaacctttgccatagttattcctttgcgtgggtgcctgtgcccctctcccctctgccgtgcttaatatatcttttctttaatttgaattgagccc

SEQ ID NO: 14651 - DNA, 306 bp, Homo sapiens
cttcttctatcttggtttgatcctgactgctgtcatggcgtgccctctggagaaggccctggatgtgatggtgtccaccttccacaagtactcgggcaaagagggtgacaagttcaagctcaacaagtcagagctaaaggagctgctgacccggagctgtccagcttctttgggaaaaagacaaatgaagctgtctttccagagagcgtgaatgagcaactttgaaagcaacacgggacacagaggggggagtttcaagagtactctgtctctctctcctcctatagtccatattgtttatgagta

SEQ ID NO: 14652 - DNA, 325 bp, Homo sapiens
caccaatccgctgaagagctcaggaattgaaaatggggccttccagggaatgaagaagctctcctacatccgcattgctgataccaatatcaccagcattcctcaagggcttcctccttcccttacgggattacatctttattgcaacaaaatctagcgagagatttatgttgagcgctgaccctaaagggctctaataaaatttgcgcaaagttggggtttagagtttaaaacagcatctcttctgtaaacaatcgctctctgggccaacacgcctcatctgagggcagcttccactgggacaaccaacaatgctcaccagagt

SEQ ID NO: 14653 - DNA, 327 bp, Homo sapiens
actataggtttgggaaaaccataccttaaggttggtcagcagtcagacaactctaatgtgtgtagtgataagagattcaagtaacatcagttctcctccttttcatgcctttccctcccaggtgcagccttttatttttaatggggacttggaaaaatttttccctttcccctctctgggcttatttttccccagggggccttttcaaaggggtttctgggatgccccctctgtatggagtacccatctcccccagggctctggggttttatcctgtttttgttttgactactggtttccaaattctattttctgctacaatgtggt

SEQ ID NO: 14654 - DNA, 311 bp, Homo sapiens
taatatataagtagaagtatgagaaaatgatttcctagaatgaggatggcaaatttaagttcccattctgtctttagctgttcagcatgtccataacagatatactaatgaattacaacctttgttttgaaatttgcacaatgggcctaaaagctttcttagagctaaggctctcagggagagatatttggggagtgtagaggaacacaggaactctatttcacattctcggagagcagggtggtgcacactctttgcgtctcccacacatataaagaagagtgtctgggacacacatatctattctacac

SEQ ID NO: 14655 - DNA, 324 bp, Homo sapiens
cctcgctgtctttggcagccgctactggaacctccacctcgactccagcggccccgacagcacggaagcagctggataaagaacaggttagaaaggcagtggacgctctcttgacggatttcaagtccaggaaaaacaattatgggttgcttttgaatgagaattaaagtgttattttttaatttggggggtttataggaaaaatccccaatgaaagagactctggggggcaaaaattagcccctcctcaaagaggtattcgcaaaagtttacaggagatatctgtatataggacgagggatgcccccattccacctccctgag

SEQ ID NO: 14656 - DNA, 328 bp, Homo sapiens
cagaacttctgaaaccagagaactgtaatcatctctattggcctggggtgcctgtgctataaatgagtttcttcacatgaaaaacacagccagcccaagatgacttatcttggtttaggattcaatagtattcactaacggcttattacatgagcaatttcatcaaatcttccaactcttaaaagggtgctttccggaaacacgcgtttatatcccgaggagtgtgctctaatatcaaaatatccctgggcttttggggttttttttgtgagagggtttttaaaatccctttccctcctaaaaaagttttttataaaaagaaagataa

SEQ ID NO: 14657 - DNA, 153 bp, Homo sapiens
ttcatagacctggatttaaagtctggccttgaggcaccgtggctcacgcctgtaatcccagcactttgggaagctgaggcacgcggatcaccttaggtcaggagttgagaccagcctgaccagcatagcgaaaccccgtctctactaaaaatg

SEQ ID NO: 14658 - DNA, 232 bp, Homo sapiens
ctaagctgtggcctcaagcagatggctgaaaaaataacgcagtaagatttgctttccaatgccttaagagtttgcatttgtgtactttgagtcagttgggctaagagggaaatagcagtttgttcttcgtactctgatagattggatgatgtggctcccatgtggtaaggggaggttagagacaaggcactctaatataacaattggggggaatatgctctcacaagaccca

SEQ ID NO: 14659 - DNA, 299 bp, Homo sapiens
acattcctttgcaaaggatcttcttcatccctctccagaagaggagaagaggaaacacaagaagaaacgccttgtgcagagccccaattcctacttcatggatgtgaaatgcccaggatgctataaaatcaccccggtctttagccatacacaaacgggaggtttgtgtgttggctgctccccattccccttgcaaagctacagggggggaaggacaggttacaaagggggtttttccccacgggggggggcggcacaaagggctctcagggaaaagaagtggggaacccttcactaag

SEQ ID NO: 14660 - DNA, 141 bp, Homo sapiens
tgggcaccacgcagggcttctgctgaggggcagcgggttgtggaccgcgataatttttctctttgtagatagagattttacaaatgctttaaacatggtcwaggttgctacgatttgacttggcgtttgatttttcgaatt

SEQ ID NO: 14661 - DNA, 188 bp, Homo sapiens
gcagtcacatttgtactgtagttcaataaaagaaaaatgaagtattctgtagcctatatttttcatagagctcatgaggcatttactgtacttgctgggtcttgccaaggatcatttatttccgatgcatttgccaaaggtgtcttcataccaaatttaaagggtgggttttaattatatgttttcat

SEQ ID NO: 14662 - DNA, 240 bp, Homo sapiens
  misc_feature 35: n = A,T,C or G
tcaccagcattcctcaaggtcttcctccttccctnacggaattacatcttgatggcaacaaaatcagcagagttgatgcagctagcctgaaaggactgaataatttggctaagttgggattgagtttcaacagcatctctgctgttgacaatggctctctggccaacacgcctcattgagggggcttcacttggacaccaccaaagcttaccagagtacctggtgggctggcagagcata

SEQ ID NO: 14663 - DNA, 130 bp, Homo sapiens
ggcgccttaccgcgctgatcctgattcacactggtcagagcagtgtgctgtatgtagtcttcacttgagatagatactgcatgtcatttttctgccatcagaatggcgagaattgggttttaggattggw

SEQ ID NO: 14664 - DNA, 105 bp, Homo sapiens
gttgcagtgagctgagatcacgccaccatactccagcttggacgacaaagctagactctgtctcaaaaaaaaaaaggattcccttaataaatgttccccctaact

SEQ ID NO: 14665 - DNA, 135 bp, Homo sapiens
gtggtggccactgcgcagaccagacttcgctcgtactcgtgcgcctcgcttcgcttttcctccgcaaccatgtctgacaaacccgatatggctgagatcgggaaattcgataagtcgaacctgaagaaggcagaa

SEQ ID NO: 14666 - DNA, 226 bp, Homo sapiens
tgtggctgatctacatgagaagtatagtggctctaccccctgacagagggtggatgcagctgcttgtgtttcttggggtgactgtcattgggaatacggacacagtgacccatcctccatcctatttatagtggaagggccttcaattgtattcagaacttttggtaaagctttggcacattgacctctatgtgttaccagtcattaatgagctgctgcagaggtg

SEQ ID NO: 14667 - DNA, 329 bp, Homo sapiens
tgaggcagccagcgcaggggcttctgctgagggggcaggcggacttgaggaaaccgcagataagtttttttctctttgaaagatagagattaatacaactacttaaaaaatatagtcaataggttactaagatattgcttagcsgttaagtttttaacgtaattttaatagcttaagattttaagagaaaatatgaagacttagaagagtagcatgaggaaggaaaagataaaaggtttctaaaacatgacgcaggttgagatgaagcttcttcatggagtaaaaaatgtatttaacagacaattgagagagaggactacagagccccg

SEQ ID NO: 14668 - DNA, 180 bp, Homo sapiens
ccgtgcctaccatggtgaccacgggtgacggggaatcagggttcgattccggagagggagcctgagaaacggctaccacatccaaggaaggcagcaggcgcgcaaattaccccctcccgacccggggaggtagttacggaaaaaaaaaaaaaaaaaaaaaaaaaaaaaaactgggggccc

SEQ ID NO: 14669 - DNA, 294 bp, Homo sapiens
acccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgattttgtcactgaaaagaagagaaggactgacacgcttcacttttatgaacaactattttgagar

SEQ ID NO: 14670 - DNA, 326 bp, Homo sapiens
tggtgtgattccgtcctgcgcggttgttctctggagcagtgttcttttatctcccgtccgccttctctcctacctaagtgcgtgccgccacccgatggaagattcgatggaccatggaccatgagcccccctgaggccccagaacctatcttttcggttgtgaacctaaaggccgccaaagattatcactttacggtggataatgatgaaaatgagcaccggttatctttaagaacggtccaatttaggggctggtccaaaggatgagttgcacatgttgaagcagagcaattaaattacggaggcagtccaattaaagtacaatt

SEQ ID NO: 14671 - DNA, 438 bp, Homo sapiens
gcccaccgcctgccgacttgtgtcatgccctacgttggtataatcacatcaagtcttacgaaaaggaaaaggccaggtaaaatcatctttgtatagagctgaagaataagactgctctcgaagtttatcaggatgttcacatgacaaaactggacccaggctactttagttttgttgggatattgtaagctaaatttttctgtaaccttagaaggccaagagactgaagccctccattttttcacagaacaggtagaacatggacagcagcaattcaacttttccccacactgccctgccaatgtgcctcgaccttgacctggggggcccacctctggggtgagagggtggctcattcattcagtccttgccattcttctgaaactgccaacaagggtggaagtttggggaagtggactccagttcactaagaatgga

SEQ ID NO: 14672 - DNA, 513 bp, Homo sapiens
taactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttggttatgtttaccttccttactagactgtgagctcaagagcaggccggcttaattattcctttctgtacccctaggggcttttatggtctcagcccctataca

SEQ ID NO: 14673 - DNA, 495 bp, Homo sapiens
acttactattaaaagttgccaagaaagctaagctgtggtctcaagcagatggctgaaaaaataacgcaggaggatttgctttccaatgccttaagagtttgcatttgtgtactttgagtcagttgggctaagagggaaatagcagtttgttcttcgtactctgatagatgggatgatgggctccatgggtaagggaggttaggacaagccactgaatacagttgggggaaatgtctgcaagtccatattattttttgtctgatttgcaagacctgtttcttgtagatttgatcataaccctgagaaatattggcagactagtctgtcagggagtaatattctacccaaactcacacaggaacattttgaatgctgctgagagccaaagcaatagggttgccaggatgagcaaataaaaatctagtaaatccaggacacccagtaaattggaattgctcaacaaaaaaaggaagataattatatcccatcactatt

SEQ ID NO: 14674 - DNA, 288 bp, Homo sapiens
aggcagccagcgcaggggcttctgctgagggggcattcggagcttgaggaaaccgcagacaagatgttttctctttgaaagatagagattaatacaactacttaaaaaatatagtcaatagggtactaagatattgcttagcgctaagtttttaacgtaattttaatagcttaagattttaagggaaaatatgaagacttagaagagtagcatgaggaaggaaaagataaaaggtttctaaaacatgacggaggttgagatgaagcttcttcatggagtaaaaaatgt

SEQ ID NO: 14675 - DNA, 135 bp, Homo sapiens
aataaacgaaagtttaactaagctatactaaccccagggttggtcaatttcgtgccagccaccgcggtcacacgattaacccaagtcaattaggaggccggcgtaaaggggtgttttagaatcaaccccttcccc

SEQ ID NO: 14676 - DNA, 258 bp, Homo sapiens
tcatgagcgaagtgaaattgcattgaatttcaagggaatttagtatgtaaatcgtgccttagaaacacatctgttgtcttttctgtgtttggtcgatattaataatggcaaaatttttgcctatctaggatcttcaaattgtaggctttgtaacacaccaaataaccttttgtgtgtcaacctaaaatttatatttgggtgggaagggttcctagtgtcccctcgctcaagggtagagtagtataaaatgtttgtgtw

SEQ ID NO: 14677 - DNA, 188 bp, Homo sapiens
caaaacgtttagcccagtcacacccccacggtaaacagcaggtatttacccttgggcaaaatacgaaaggttaacaagcatatcaaccccaggggagggcaaatttgggccaaccaccgcgggacacagggaaaaccccaggcaaaataagccgggcgcaaagagggttttaggaaacccccccccca

SEQ ID NO: 14678 - DNA, 266 bp, Homo sapiens
tttggtattggctgccgacacagagcagatccccatttaactcttcagacccaaccctttgtttatggcctacctttctttcacacggcatacggcttttctgcctaccatgcttttaaggggttggagtgtccgtattcgagaaggggttggaaactggttctgggttttgtaaatctgtgtgtttctctaaaggttttttttgcgggggatacacatattttttgcggggtgggggttttttggggcccagaatttttttaacc

SEQ ID NO: 14679 - DNA, 161 bp, Homo sapiens
ttcctgcgtccaggatataaggccaagagacaaaaaagccatagcctgaaagatttagcaatggtggagtaatgtcttcctgtgctgatacaagcatgaactttcttggatattctgctaggctgaaattacaggagggtgtcttgggtaggggggaggcc

SEQ ID NO: 14680 - DNA, 345 bp, Homo sapiens
acttctgagacaatgtcctcaaggagaccttgaaacagaaggtcagcacatgttgaaaggaatgtctgtggccaagagaaagaatagaaaatgggttacaggctttctctgtatcacagagagctcttgcaagattctcgatgatgttacattcatctttctcttctgtaaacaaaagtaggtgtctttctaattccatttcaaaaagaaatacccttaaggttctctactctctgccatatgacacattcaaagtgagaatacacatagtgaatatcccgggcactcgaaacacagacaattacaaagatgtgggcacgtgcaaagagggcgcgtttagacgac

SEQ ID NO: 14681 - DNA, 315 bp, Homo sapiens
ttttaggtactaatttaatgctttagtttttactactttgaaaggggaggttcatctaagtattactgataacagggatcccacttaaagtaaaagttggaaagggcaagagtcttttaagcggaacttcaattctgttgtcatgggtacttatatataatggctatccccaggcaaatagggctttgggaaatgtgtggatattctccaggcacagagggctatgagaggtgtttattagggtgaggggcacatctcccggaggggggtctctcttagtgcacatctctcctcccatttcacagggcacatcga

SEQ ID NO: 14682 - DNA, 200 bp, Homo sapiens
actgtttttgcttcacagaagaaattccaatacgaaatggtacaaagtcatgatgattccctgagtaacaaagggaaatgaaaactttttgtgatcttcgcgtattcactgaaaaataaatgcttgtttgggatccaattttgttcccgggaggttttttagaggacccagacccttatccctttgagagaggaggggcg

SEQ ID NO: 14683 - DNA, 417 bp, Homo sapiens
tatgacaataaattagtattctgatatttgctagattattttcatgataaaccccgacactaagctattaatacggcttggtcttaaggatatcttggagggcatgctctgaaattcccatataagggaggttaaacctgaaccttaaggggccctcaattatacaaggggtatggaactcaggaaaataaaatctctggtagctcgacccctcttcgcctgtgtggagagaatatattctctatatacagggggaaactgtgagctgtgatacacgtcaaagagagtctctcactgggcgcgactctcgagagggagagaatgagagagaaagagataatgcgatatcatcaaacgtggcgcggtgtggggctcctcctctgtgagagagagtaatacaggagtacactgctccta

SEQ ID NO: 14684 - DNA, 400 bp, Homo sapiens
atttcatatccagccaaactaagcttcataagcgaaggagaaatgaaatcctttccagagaagcaaatgctgagagactttgtacaccatcaaggtttgctttacaaggagctccctgaaggggggcacttaatttggcaagggaaaacggttacacgccactctcaaaaaacatatataaatatgtataacacactgtgacacactaggagggaacacacgtatgacacacacagggcaatttaccccattctgcgttttatatgtcacaggtcctcatactccacatatcactctatttcccctcatatatatgggcggctaatgccccccctgttgagacgacaacagtctcgccatctggggacggcgttatgaagccccatgttttctgggcctc

SEQ ID NO: 14685 - DNA, 388 bp, Homo sapiens
cttcattgactacaatctttatggcatgaatttaataaatctggcctgctgtcaagttcccaaaagcaagaagggaaaggaatacattgcatgcaacttggttcttcaaggataaattataaaggaattcttttgctggtactttatttcggttggcaccaggtgaaaatatacaagctctcttatatatattgagaggtgtgtgagaccacacacgtcccaaatgtgggttatgagaggtgagatctctatgctctctcgatatatctaaatccgggtcgggggacattatgctgctacatttcggaggaggacccccggggtacaacgaccccttctgggagtggtagcaagcagccagccgcggaggacaacatattagaatttg

SEQ ID NO: 14686 - DNA, 316 bp, Homo sapiens
ttattttgtactgcagaattccaataaatggctgggtgttttgctctgtttttaccacagctgtgccttgagaactaaaagctgtttagggaacctaagtcagcaggaattaacttattaatttcccttatgttgagggattgaaaaaaaatttggaaagagaaaacttaggttataatacggggactatatatgagtaacacttgatgtcccctctattctcaagtgagagagacacactcccgcgaaaagagggtgttaggggcgcgtagattagatatctcattatcaaatacttcatctctactacgtagaa

SEQ ID NO: 14687 - DNA, 322 bp, Homo sapiens
tctttgcaaagtaattaggttatgagagtggcgccctcattaatgggattggtgcccttataagaataggccagagagctttctgctttctaccacatacggatacaagggggaaaaggttatcttccaaaacagagaagaggggccctctaggaccacaccctgctggcaccccaaacatatggtacccctcagactcccacggactctgagagataagtgtcttttatatacacccccccactctctattactcttttataggaggccccactcaaacagatctcttccctcttctttaaaaaagagaagagatagggtt

SEQ ID NO: 14688 - DNA, 264 bp, Homo sapiens
aaaaggtctctgtaaatatttccacagtcaaaacttgcagaaagcagtttaccacagaaacaatttaaaggtcttcagcctggcaaatcttaccttcatggaatgtttatgtcatagggcattggggggcactctgtaaagaatcagagtaagggttgtgaaaactaggaaggtctgttaggttaccttcttttaggggtttttttttgggggcctcggggggggccattaaacaccttaggtttaactgctcctccccaggtt

SEQ ID NO: 14689 - DNA, 262 bp, Homo sapiens
ctaacaaacccacaggtcctaaactaccaaacctgcattaaaaatttcggttggggcgacctcggagcagaacccaacctccgagcagtacatgctaagcttcaccagtcaaagcgaactactatactcaattgatccaataacttgaccaacggaccaggttaccctagggataacagcgcaatcctattctggagcccatatcaacaatagggtttacgccctcgatgttggatcaggacatcccgatggtgcagccgct

SEQ ID NO: 14690 - DNA, 265 bp, Homo sapiens
  misc_feature 236: n = A,T,C or G
ccaaagtgcgaaaagttactttcaatggactgaaccagatgattgtcatagaactgggcaccaatccgctgaagagctcaggaattgaaaatggggcttctccagggaatgaagaagctctcctacatccgcattgctgataccaatatcaccagcattcctcaaggtcttcctccttcccttacggaattaaatcttgatggcaccaaaatcagcggagttgatgcagcttgccnttaagggccttaataatttggctaagttg

SEQ ID NO: 14691 - DNA, 261 bp, Homo sapiens
  misc_feature 228: n = A,T,C or G
tccttacagccgctcgtcagactccagcagccaagatggtgaagcagatcgagagcaagacttcttttcaggaagccttggacgcttcaagggataaacttttagtagttgacttctcagccacgtggtgttggccttgcaaaatgatcaaggctttctttcattccctctcttaaaaggatttccacgtgtatatttccctgaagtagatgttgattactttcaaangatgtctctttagagtgtgtaagtgacattcaa

SEQ ID NO: 14692 - DNA, 199 bp, Homo sapiens
cttatcttgccccatccccgttagtccaaactcaagaggcagcatggagcgtggtctgcttccccactactcacggctctgcaattgtgggcaccaagaggccaacccttgccttttccggaaacccttgagaacggtgacgtgaaattcaactgttttcctcatccccaaggaaacagaaaccctgctgtaagttaat

SEQ ID NO: 14693 - DNA, 270 bp, Homo sapiens
acttagcggagccggtgacaggatgttggtgttggtattaggagatctgcacatcccacaccggtgcaacagtttgccagctaaattcaaaaaactccctgggggcagggaaaattcagcacattctctgcacagggaacctttgcaccaaagagagttatgactatctcaagactctggctgggtgatgttcatattgtgagagagagactctcgatgagaatctgaattatccaggacagggaagttgtgactctttggacagttcac

SEQ ID NO: 14694 - DNA, 272 bp, Homo sapiens
cattttctgtgcttatagcatagtaatgaacgtctgacaggcgcgacctttcataagacaacccacactattggctttctgcccagaatattgctgcaacaaatatctgtgattgggttatctctctattatgcattgcttcacaaggggaaacggcccctttttttaataaatctacgcatggctggctgcaatatgcctcactgttagggattttgtgtatatatgtgtgggagagagagagagagggctgccctcgaatataacccagt

SEQ ID NO: 14695 - DNA, 256 bp, Homo sapiens
agatggagaaaatgcttaatctgaggatgagacagggttttttcatttttgtgggggctagaaaaaacataaaatgaggcagttaaatatttatagttaatgaaggtgtcctacagaaaataatctggtgttcttgctaactttgcccttcactgttgcttaattgtgaacagccaaaagctgtatgttatggcttattgtgtgaaggtaactaagaagttgtgttccatgacttcagagtacaaacatgcgggag

SEQ ID NO: 14696 - DNA, 268 bp, Homo sapiens
aggccaaggcgggtggatcacctgaggtcaggagtttgagaccagcctggccaacatggtgaaaccctgtctctactaaaaatacaaaaattagccaggggtgctggcatgtgcctctagtcccagctactctggaggctgatgcaggagaatcgcttgaactaaggaggcggaggttgcagttggccaagattgcgccacttctcttcagcctttggggataaatccggtttagactccatctcaacagcaaaaaaaagtgaagaga

SEQ ID NO: 14697 - DNA, 186 bp, Homo sapiens
attttaaacatatgattattttttaattttatgccttttcagtactaaacacccattttcattgactgattccggtactaagaggccattcacgacagcatggcgatagaaagaatgaaaaaaccccgctgaatcatacagtaattttctttaaagcacatagtagttacatacaaaataatatat

SEQ ID NO: 14698 - DNA, 159 bp, Homo sapiens
ttgtggtcccgaaatagcccaaggttttttcaagtaggggccatttggggccttggttgctttacacagcttggtttcttagggtataccttttgccgtatattgccgggggttgttctttataggctatgtcgaagttgcgcatataccatcagaggt

SEQ ID NO: 14699 - DNA, 122 bp, Homo sapiens
ctgaactttatgagatcttgagactaacacatcacacacttccttccaagacacagcccaaatagaggagaaaactgctggcagtagaatccacattagaaccttagcagagacactaggga

SEQ ID NO: 14700 - DNA, 232 bp, Homo sapiens
cttctgctaggaacaggcggacttaaggaaccgcagataagtttttttctttttaagatagagattattaaaactacttaaaaaatttaggaaataggttaactaaggtatttgtttggcgttaagtttttaacggaattttaaaaagtttaaaggttttagggaaaaatttgaagttttgggggttggctttggggggggaaaaaaaaaaggtttaaaaaccacccggggt

SEQ ID NO: 14701 - DNA, 222 bp, Homo sapiens
ttgtctctgtgtacagaatacatacttattcccatttttaagcatttgcttctgttttccctacctaggaatgtcagatgtttttcagttatctccccattttgtcaaaggtggacctcaagggaaacaatttttcattaaaggaatcttgggatctagggacacaatttttttttctacaaggttttttggggcaccccacattttttgggaaaactaagt

SEQ ID NO: 14702 - DNA, 211 bp, Homo sapiens
cacttcacactcctctctcttgttctgaatggtgtttgtgtcagtctgcagctgtgtatgggattatgtcttaaaatcccggataaattctatcccatccagtaaaatctaatgtagagaaataagttccccgggaaaaggaaaaatgttgggctttctttgaaattttgggtgcacaaaaccccctttccctggagggtgttttggtggg

SEQ ID NO: 14703 - DNA, 180 bp, Homo sapiens
ttaactctctagtttcacaacgctctgcagaattagcttgtcatttaaaaatgcctcttgtggcccggtgttggtggcatgcacctttagtcccagctatttggggaggttgagggtagaggatccctttaggctgggagttttagacccccctgggcaacatagtaagccccttcccat

SEQ ID NO: 14704 - DNA, 148 bp, Homo sapiens
ccttttattttaacatgatgtccatgaagaggtttgccgtctgggcagcctgtcggcaaggagcgtccatactgcgtttgtgtaattgtttgctgtatctcccttccctctgagctgtattgttctttaatggctgtcttgcccttcc

SEQ ID NO: 14705 - DNA, 206 bp, Homo sapiens
tccatcagtctggccaacatggtgaaaccttgtctctactaaaaatacaaaaattagctggacgtggtcatgggcacctgtaatcccagctgctcgggaggctgaggcaggagaatcgctttaaccccggagtcggaggttgcagtaagctgggatcacgccactccactccagcctgggcaacaaagcgagactctttttcaacg

SEQ ID NO: 14706 - DNA, 216 bp, Homo sapiens
ttttggtacttgccagcatcctacactgttccaaatagtctgaagcacaatattggggtgaagaactaaaaggagatttgcgggagtatctggggtaaacatgtcaaattgtctactacttatttttcaaaaggttttggcaaaaaaggttatctaggggggggaaattaaattaggttattattcagttacatcacgggtaatacggggggcacw

SEQ ID NO: 14707 - DNA, 211 bp, Homo sapiens
tttgataatgtacacatgacggaaatacagtacataataatatccctatgtttgaaataaggaaggaatcaaattttaatttacaaaccaacacaaatttattaaagggataaaatttcttaagaaaatgggcttgagtgccagtggctcaagcccctaatccccccccctttgtgaggccaaggtgggggggtccccttaacccccagag

SEQ ID NO: 14708 - DNA, 171 bp, Homo sapiens
aagattgtttggtaaggagtaatgacattctcttgcatttaaaagtggcatatttgcttgacatggaaaatagaattctggtcccttttgcaactactgaaggaaaaaaaaaagcagtttcagccctgaatgttgtagagtttgaaaaaaaaaaaaatttgggggcttttg

SEQ ID NO: 14709 - DNA, 315 bp, Homo sapiens
aagctgacagcattcgggccgagatgtctcgctccgtggccttagctgtgctcgcgctactctctcttttctgggcctggaggctatccagcgtactccaaagattcaggtttactcacgtcatccagcagagaatggaaagtcaaattcctgaattgctatgtgtctcgggttcatccatccgcacattgtaggctgcacttactgtaggaatggaggagagaattgtaaaaagttgagcattcagacttgtctttcagcaaggactggtctttctatctctggtactacactgtaattcacccccactgtaaa

SEQ ID NO: 14710 - DNA, 230 bp, Homo sapiens
ctggtgatagccggttgtccaagatagaatcttagttcaactttaaatttgcccacagaaccctctaaaattccccttgtaaatttaactgttagtccaaagaggaacagctcttttgacactaggaaaaaaccttgtagagagagtaaaaaatttaacacccatagtaggcctaaaagcagccaccaattaagtaagcgttcaagctcaacacccacttacccaaaaaa

SEQ ID NO: 14711 - DNA, 327 bp, Homo sapiens
aatataattttaaaaaatttctctccaacctccttcaaattcagtcaccactgttatattaccttctccaagggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctgtgcttgtccctctagtctaaggtggctgcttcttccccagccaagagtcagtttgtgcccctgtaataatacaagagcccg

SEQ ID NO: 14712 - DNA, 322 bp, Homo sapiens
gaaaagaaactatgtgttctcccctacagaatgctctgccataactttgtgagatgacatgattcaggaattatgtccttggcttctcatagagagttccaaatcacgtcaccttgctttgtggagaaaatgaccagttatggatagcaagtacatttgaagctgcttccgttgcttagggatctatctaacagtatgaggctcagtgagaagttttgccctttctccctaggaggacgtgctttctacaaacagccaatgttctgagctgccttcttaaagatgtgatttcaggagctcactgcagactttctatgcaact

SEQ ID NO: 14713 - DNA, 332 bp, Homo sapiens
ttgccattgtcttattggcacatgggtggacacggatctgctgggctctgccttaaacacacattggcaagctttcaacttttctctttagtgttctgtttgaaactaatacttaccgagtcagactttgtgttcatttcatttcagggtcttggctgcctgtcggcttccccaggtggcctaggaggtggggcaaagggaagtgaacagacacacgatgttgttcaaggatggtgtttgtggactagagggctcagtgtgttggagagatccctgcagaacccaccaaccagaacgtgggtgttgtctctaggctgttaactctagagaaa

SEQ ID NO: 14714 - DNA, 273 bp, Homo sapiens
aagaaagttgttgaatcactaattcagaagactgtgtgaaaggcacaagtgaagagagccttagctagggagggaaggaaccaccctgagactgatagaaatgggatcacggtggcagtcggtaccatgacaaggagtgcctagaagctgagatagaggataccaatagtctcaactctcttaatgcagttgagacaatacagtctgctgaaaatgagtcagggtagccggacgtagtggctcacactctgtgatcccgcactttgagaggct

SEQ ID NO: 14715 - DNA, 302 bp, Homo sapiens
aacactttgctctgtggtgtcacagctttgtgacaataagatggcaatctcggatctacaaggtgctttgtcgggggatcaaataaaatatgttatcagagatatcatcacatctatagtgtttaacagagctttatgccaactactaagacaaagctttaacaaagcttatagaatactgacactcgtaacaattacctctctacgtgatgctgtaaggaatcttgctaatttgtgtaggtagaggatgcatttaggatagggtttagtatctaccaaaagtacttgacctcaagtgaacc

SEQ ID NO: 14716 - DNA, 236 bp, Homo sapiens
atgctgtctctgatttagctgctgcctccagccttggcttgagaacttactaaaggcacttcgctcctagttaaacccctgttaactctccataaatttggtgattctctgctaggcctaagattttgagttaacatctcttgaagacaaactccaccttctgtgcttttttgcttggggtaatggagtttttctttagtaagagtgccaagaatgacaagatattaaaaaaaaaa

SEQ ID NO: 14717 - DNA, 136 bp, Homo sapiens
ttaggcagccagcgcaggggcctactcctagggggcaggcggaacgttaggaaaccgcagatacaggggtttttttccctctttaaagaaatgagaataatatcaaccatcctgaaaaatatatgtgcaacatggg

SEQ ID NO: 14718 - DNA, 173 bp, Homo sapiens
tattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatgggg

SEQ ID NO: 14719 - DNA, 163 bp, Homo sapiens
acacaagaaagaggggttagttcttgaaaactagaatgtatatgacttcctttgttataagtaaagggggtattctgaatgtttgaagtagagagctgggaagttgaagttattcacgtttaatgggttccctgctttctaggaagtagggatattataaaat

SEQ ID NO: 14720 - DNA, 184 bp, Homo sapiens
tttttcttttccttcgctaacgcctcccggctctcgtcagcctcccgccggccgtctccttaacaccgaacaccatgccttcaattaagttgcagagttctgatggagagatatttgaaggtgatgtggaaattgccaaacaatctgtgactattaagaccatgttggaagatttgggaattga

SEQ ID NO: 14721 - DNA, 184 bp, Homo sapiens
aaagatgaaaaattataaccaagcataatatagcaaggactaacccctataccttctgcataatgaattaactagaaataactttgcaaggagagccaaagctaagacccccgaaaccagacgagctacctaagaacagctaaaagagcacaccccgtctatgtagcaaaatagtgtggaagat

SEQ ID NO: 14722 - DNA, 172 bp, Homo sapiens
ctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccag

SEQ ID NO: 14723 - DNA, 181 bp, Homo sapiens
cacaatattttctctagcaactaatgagatgtggcgatcaggggatagtgaagtttaccaactgggtgatgtcagtcaaaagacaacatggcacagaatatcagtattccggccaggcctcagagacggggcatatcaatatgtgaaaaaggggtctcgaatttatttggaagggaaaata

SEQ ID NO: 14724 - DNA, 182 bp, Homo sapiens
ccatcttggctcactgcaacctccatctcctgggatcaagcgatcctcccacctcagcctcccaaagtgctgggattacatgcatgagacaccacacctggccagattattcttcaatggatgtttactcaccctcttaaaatggcagagtcttcaattagcaaattgtggcctagatctgt

SEQ ID NO: 14725 - DNA, 173 bp, Homo sapiens
tcaagaaagttctagaatttgaattgataaacatggtgggttggctgagggtaagagtatatgaggaaccttttaaacgacaacaatacttctagctttcaggatgatttttaaaaaatagattcaaatgtgttatcctctctctgaaacgcttcctataactcgaggttata

SEQ ID NO: 14726 - DNA, 169 bp, Homo sapiens
tcagtaagattgagacttagttaagattccccttggaaattccttaatgtttattagcttctaactagtgttgtaagtcccatgccagaatttggagatttgagttcttcttttcatggcttttattcactgtgactaataagcttcctaataaatccttgccagactt

SEQ ID NO: 14727 - DNA, 123 bp, Homo sapiens
cttaaggatgtcccccacttccttgtctaaaaggattttttaaattctttttcaatttttaacgattacgaagtttttaaacttttagggcccaattttgggatttttgggccgaacttaaaa

SEQ ID NO: 14728 - DNA, 169 bp, Homo sapiens
cactaagttagaagtgatatctggggatctgaagagtgactttcacctgctcgcgctggacagcgatggatttaagctcgagaattttttagctgaatggtcataatcagtgtagtggtcctcttctgataacatgttcagactgctaggtgcggcctctatttgtata

SEQ ID NO: 14729 - DNA, 164 bp, Homo sapiens
ctgtactgtacaacgagtgtgtgtactcattaaatctcaatatatgtgatctgctcagcagtaatatatctcagtatgtatatagtgaggtctatacagggctgtatgttctgcacacacagcacatgtgtctacactctgtgtggtctctgctgagatctctc

SEQ ID NO: 14730 - DNA, 159 bp, Homo sapiens
aatactcactccatagttcagcattctcaatgggggtttgaacatctttcatccttgtagagcctcaattctccctttctctatataatatcataggcactctaaatagtgatcataataaatactggcgtgtctctaaaaaaagagaaaaaaaaaaaw

SEQ ID NO: 14731 - DNA, 148 bp, Homo sapiens
atggattgagaagcatgtatctggtaattgttggaggatgcatgatgccctctcaggtgtctctcacagtcttggggtttggccggggttgattctcatctgtgcgtgtctcgtgtgggtcttcggtgatctcagtgtggctggtcay

SEQ ID NO: 14732 - DNA, 265 bp, Homo sapiens
taaattgtaactgattaagaattgtgatagttcagcttgaatgtctcttagagggtgggcttttgttgatgagggaggggaaactttttttcctatagacttttttccagaataacatcttctgtagttcataaccagacctggccagttatgatggccctagaatgtcagagaaaacagactccctcgggtgtaattgataagttaaagtgcagaaaacggtttatatgttcataccctccattggggtagtacggcataaccc

SEQ ID NO: 14733 - DNA, 281 bp, Homo sapiens
aagaaaaaccttttcacgaactacctttttaccaaaaagtgtggctacttaagggtctttgtgactttgtgtatgaaaacacaaaaggaaggttcaagaatgctgtacttggaacaagcctatccatgaatgcagggaagttattcttggttatgattatttggggaatgcttatgtacattttccacagttctgtggtgcagatgtacggatttataaacagagaccctttcaggccccagaatttccaattccacccattaaaatacaaagagtacctc

SEQ ID NO: 14734 - DNA, 275 bp, Homo sapiens
tgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtatagtgcatataagttctaacaagtgtatttgtgttatctataaaataggacaattgtatctttgagggggtaattc

SEQ ID NO: 14735 - DNA, 219 bp, Homo sapiens
  misc_feature 38: n = A,T,C or G
ttagagtatgaaaaccagtattcaattttccatcttgnttgagcttgtaaaatgccagcactttaaaactaggactgttcccccccataagccaagagaggtagaacttactaatacaagggcttaaagaagggtaggattttgttttcaatattttggggtaatatttaggacaggttcgtacccaccagggaaggaccgaggcaaggtcttccccaa

SEQ ID NO: 14736 - DNA, 136 bp, Homo sapiens
tttacgaacaacagaatttataattatgagagggaatcaagacagaagattgatcattgtccacaagtgcggtgtgttcttttaaaggaagggcagcagaccataaagcaaacatgatatactgtgcccctacaga

SEQ ID NO: 14737 - DNA, 222 bp, Homo sapiens
aagatgaaaattataaccaagcataatatagcaaggactaacccctataccttctgcataatgaattaaccagaaataacattgcaaggagagccaaagctaagggccccgaaaccagacgagctatcctaaggacagctataaaagcacacccgtctatgtagcaaaatagtggggagagttatagggagaggcgacaaacctaacaggcctcgggatagc

SEQ ID NO: 14738 - DNA, 310 bp, Homo sapiens
acgaatcctttaaataaaatagctctaaggtgttgtcctaaggttagactgatagaaatttgatcaccattttaagtacctaagagggtttctyttttttttaaatctaaggtttctacaccttaggagcttcctgaggacataaattgttctaaagaggggcatatcaattttagtttttcttatacaccataatttccccttcaaaatttatttctgaaatatatcggctctacatgatcattagcagttcttcgactattaatcttccagctattaccagtgtatttattatcccccactgaggagc

SEQ ID NO: 14739 - DNA, 626 bp, Homo sapiens
atttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagta

SEQ ID NO: 14740 - DNA, 607 bp, Homo sapiens
gtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaagaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccccgctccccaaaaatttgaatttttttttcaacactc

SEQ ID NO: 14741 - DNA, 304 bp, Homo sapiens
atataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttaaaaaaaaaaaaaaaaaaaaaaaaaaaaaaaaaaaaaaaaaaaa

SEQ ID NO: 14742 - DNA, 209 bp, Homo sapiens
gaagcccagtttctactaaaactacaaaaattagctgggcgcagtggcgggcacctgtaatcccagctgcttgggaggctgaggcgggagaatcgcttgaacctaggacgtggaggatgcagtgagctgagattgcgccactgcactctagcctaggtgacaagaatgaaactccatctcgaaaaaaaaaaaaaaaaaaaaaaaaaaaa

SEQ ID NO: 14743 - DNA, 347 bp, Homo sapiens
tataaaattccttaaaaataaagatggcttaatcactactattgtgaaaacataactggtagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaattttttccttttaaaataaacagctgggaccatcccaaaagacaagccatgcatacaactttggtcatgtatctctgcaaagcatcaaattaaatgcacgcttttgcatgtc

SEQ ID NO: 14744 - DNA, 284 bp, Homo sapiens
agttcaccatggcatactgtaaagagccaggccagggagacctgcgaccctcgctagaccagaacatgtaggggccgatcgtgtccacctaaaaaggtctctcttagagcgcgcttgggccgagtggagcttaaacttggtacctataaagccaacagagcggcgggacaacgaaaagactcctagatgcagaagggggcatcgaaggccggcgaagccacaaaataaaacgactgcgcctgccctggagcaaagaaaactgaacggcacagaacaagagaaga

SEQ ID NO: 14745 - DNA, 238 bp, Homo sapiens
ctgtgggtcctcgggagaacttccggcatcactagtggcacttcatatgggctccatggaggattttgcaagagttacagtattgcactaaacatgatgaaaagtatgtgagaaccgcttacgaacacttcttactgggatggggccccactggagtgatgcgccgacatgccggagaagaaagcgccatacttgggccctgagcaagaacaacacaagccccccccaatagcctagg

SEQ ID NO: 14746 - DNA, 466 bp, Homo sapiens
ctgcagctggttactgcatatctccatgtggcttacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagacatcattttacaacctcatttcaaaatgaagacttttacctggaccctaggtgtgctattcttcctactagtggacactggacattgcagaggtggacaattcaaaattaaaaaaataaaccagagaagatcccctcgtgccacagatggg

SEQ ID NO: 14747 - DNA, 222 bp, Homo sapiens
agaggagccaggcccttgtacctatgggattggacgggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaaaaaaaaaaaaaaaaaaaaaaa

SEQ ID NO: 14748 - DNA, 347 bp, Homo sapiens
aaggaaaggacctgtaaaggaggggacagggagcttcctaggtctgttgataaactaactgatgctttgtcaagtcttccaagttttcactgtaaataatacaactaacaatgtaattttgctgttttctaatagagaatgaatgaatatattaatgtattacatttgtttcatgataaaacagttttcactgatactgtgaaatcctttctctcctttctagccttgcaaaataccctactaaataaatcattttagacatggagtgcaggtggacactgtgtgaactgtttttggtcagttattgtagaaattgatagatgtaccaaataaactctatgcacatt

SEQ ID NO: 14749 - DNA, 425 bp, Homo sapiens
ggcctttaaagaatagtcagactgataaagaagtgctaacagataagctatagttggggaaatttgtgggtttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcgcaaaa

SEQ ID NO: 14750 - DNA, 596 bp, Homo sapiens
atagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaaatgtcaatggtcaaa

SEQ ID NO: 14751 - DNA, 492 bp, Homo sapiens
cagacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 14752 - DNA, 502 bp, Homo sapiens
gtaggtgtaatttaggtatctcacaggtgagaagaatgttcggttaaaaattttggcagccttaacattctaaatattctgtctacagagcaagatattattagtactaaaataaacttgccattttaaaaattttaaagtgatttatgcttttacaaaatcatagtttatcagaaaagttccttctaaatgacattcaaataaaagaataaggaattatgttagctataaatatattttctttaattagaatggttcgtaaaatcttgtttttctcctgttacactcctaaattttgaaaatttgctttctgagtatgatttaatatttaatatccagtttttatgtgttcttcaacacaaataggccctgtacttgcacattttagttaaaaattcatgggcatgttacaggagatgagaattgtggtgacagacattattatgaaagctatttaatcatcacgttagcaaatcaaaatgtaaacctttaaataaaatac

SEQ ID NO: 14753 - DNA, 511 bp, Homo sapiens
gggaggaagacttaaaaatgttattttttttttagtaggactttaagcaattaattaaaagttaaatatgtcttataggtgaaattttgtatttgtgctttaaatatttgatttttaaaattttcagcatattttaataaatttactcattctttttatttccctggtattttttaaattttgaagttttatatatttaggtgaattatttcattattccactgtactacaagaaacttaattcttttataatatgaaatgtccctgcttttaaggctaattttctacttgtatactctattttattccattttgacatctcaaagacattgtttaagcagtctttcttctaccacacttgcttgttagattagcccatccagtctcatgactttaaatatatctatgactggatgattccaaatgtttttctctgacctgaggtctccaaacttatatattcaacaacttcagatcttcatctggcatctcaaagttaatatgttcaaaa

SEQ ID NO: 14754 - DNA, 343 bp, Homo sapiens
aaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagca

SEQ ID NO: 14755 - DNA, 489 bp, Homo sapiens
atttaaatagagcaaaatattctagtatcaaatcagttgtgtttaagccttcaacaggggaaccatatatcttgtacatgtatttattcctcagtaattctttatgactagtttggtttctacttgttgcataagtataaattagggaaatcagtggataattaaagtgttctttggatttttctcttttagtatctatttagatacattgatccggtttctttaatgctgagtttctcagccttggtgctattgacattttgggccggtgaattctcttttattgtgaattgttttggatatttagcagcacagttggcctcttcccacaagatgccagtagttccatttatatgtttgtgtttgggattaaggagaccaggaccttgtaatagcaacacctttattaatggagacactgtagtccttaagtcatagcagaaaatacatctgacatatgcctaaaaaaaatgactgaacagaatagtt

SEQ ID NO: 14756 - DNA, 555 bp, Homo sapiens
tctcagacagtagcataagaattgttgatataccacctttagaggtattgaacacactggataaatgtggtgaaatctggatttatctataaactcattagaggctgactcatggcaacacatgttatagttcaatatttttgtttaaatcgttgagccacatccatctatatatgtagcactaagattgtaacagctcctttacactaagcccgaattcattttacctggtgatttgatttgaaatgtatgagctgtattatataactttcaaataagtaatacaaattcaaagaatatggaaagaagagtcatacaggcacactgacagtgaattgtaatctggcaggtgacaatgattaacaggtgtgcggattcaactagacctaaatccctgaaacaatattaaaagacagaatttttaaattaaaaacattgacaatataataggcctataatatttaaaaaaatgtttacccatcatcagtcgatattaagttaaactagaaaatttgggacacactatccaaaaaaatgaaataagtcaactatccc

SEQ ID NO: 14757 - DNA, 347 bp, Homo sapiens
tgggggacacgtgcaaaccatagtagttctaaaatttgaaaatgcattgggtagacctggaggtggccaggtgtggtggctcatgcctgtaactccagcactttgggaggctgaggtgggtggatcacttgaggtcaggagtttgagactagcctggccaacatggtgaaaccctatctctactaaaaatataaaaattagctgggtggggtggtgcacacctgtaatcccagctactcaggaggttaaggcaagagaatcgcttgaacccaggaggtggacattgcagtgagccgagattaggccactgcactccggcctaggtgacagagcgagactccatcaca

SEQ ID NO: 14758 - DNA, 316 bp, Homo sapiens
ctgctttaaatgtttccctgagtttcaagttttcttatttcagactcataattatatcattttgattaaaatggagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaatttcctttgaatgccaaaccatatttctca

SEQ ID NO: 14759 - DNA, 473 bp, Homo sapiens
gactaagctctcaaaaggaaatacaacataaccaaaaatagacaaatgagataattaaactaaaaagcttttacacagcaaaacaaatcatcaacaaagtaagcagatgacctacagaatgggagaaaatatttgcaaacaatacatccaacagaaggtaaatattcagaatctccaagaaactcaaacaattcaacaagaaaaaccaaataaccctattaaaaagtggacaaaagacatgaacagacatttttcaaaagaagtcatacaggcagtcaacaaccacatgaaaaaattgctcaacagcgctaatcatcaaagaaatgcaaatgatagccaccgtgagataccatcagaatggccattattaaaaagtcaaaatgcaacagatgttggtgaggatgtggagaaaaaggaatgcttatacactgttgatggcagtaaattggacaacctttatgaaaaacagcatg

SEQ ID NO: 14760 - DNA, 130 bp, Homo sapiens
aatagaaagaaatatttactgtggtttattccttagtgttaaagagaggttaccaagccaaacactgaatactttagaaaatttctagatagacacagcttagaaatggagcttagcttttttttttttt

SEQ ID NO: 14761 - DNA, 465 bp, Homo sapiens
  misc_feature 274: n = A,T,C or G
caactgtaaaattttccagacaccagagccccacagattgcatgactccaccaatttcctgactactacgtagtcgaataccaggttcacctatttacaaaaccagctctttcttccatgttagttcaaaacatgtttctggtgttgataccaatgctccatcccagtggggagctatggatgacacaacttatttctaaaagaaatctagttcgtgtgttcaaaacttattttactaggaaagaaggaatgtatcagcaagtgcctgaaacgntctctactggtcttctaaggctgatgtctctatatttcatcttagcgaaaagagcagaaataataataccaaaaagaggggaagagaaaggacaagtggaagaaaaaaaagttagacaagatgtaacattatgaagacaaccttaatatgcccagatataactctaataggagactgaatgaatagacttt

SEQ ID NO: 14762 - DNA, 166 bp, Homo sapiens
ccgggacatcgctgctggcgaaacctgtggccgggcccaacctgaaaacagcccagccaagaactggcataggagctccaaggacaagaaacacgtctggctaggagaaactatcaatgctggcagccagcttgaatataatgtagaaggagtgacttccaaggaa

SEQ ID NO: 14763 - DNA, 177 bp, Homo sapiens
tttgcaaaaagcggaaggtttgtatggctgcagcaatggcttcaggaatttccttttctttctttacgatattgatgctggattcatgtatctcgacatagtgagcaaccacagcagcagacctcaatccatggtgcatatcaagcaatcccactttttcttacgtcctgactttgg

SEQ ID NO: 14764 - DNA, 114 bp, Homo sapiens
aaagacgaggaaagccggtggagtacaggaaaacactgcagctggaaaaacgcacaaggcctgggcccagtaaatccaataacccgcctgctggccaaaaatgcctataagaac

SEQ ID NO: 14765 - DNA, 424 bp, Homo sapiens
gcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccacca

SEQ ID NO: 14766 - DNA, 573 bp, Homo sapiens
atagcttaaggtaaattcatagagaccaaaagaatagtggttgcttagggatgaggaggctagggaaaagagtcagacattactgatggtgggcatgggatttcttttgggattgatgaaaatgttttcagattgtggtgatgattgtacaattctgtgaatatgcataaagttttgaatatatattttaacgtagtaaattttacgctatgtttattatatctcaataaaacttttatttaagaaaagacgaatacaggagcacccagatttataaagcaagtccttagagacctacaaagagacttagactcccacacaataataatgcaagactttaacaccccactgttaacattggacagatcaatgagacagaaagttaacaaggatatccaggaattgaattcagctctgcaccaagcagacctaatagacatctacagaactctccaccccaaatcaacagaatatacattcttctcagcaccacaccacacttattccaaaattaaccacatagttggaagtaaagcactcctcagcaaatgtaaaagaacagaaattataaca

SEQ ID NO: 14767 - DNA, 553 bp, Homo sapiens
aggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacagcaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatc

SEQ ID NO: 14768 - DNA, 322 bp, Homo sapiens
aacagaacgagactctgtctcagaaaaaaaaaacaaaaaccagtttaggctgggtatggtggctcaccagcgctttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaggg

SEQ ID NO: 14769 - DNA, 505 bp, Homo sapiens
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacctgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaaatgt

SEQ ID NO: 14770 - DNA, 447 bp, Homo sapiens
ctgggttgaaacccgggcgccgccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaaggtaattaaacttggatgattgtatatcaggaaaacaaattgctgagaggcacttaccctcccagtcatctgggatttgttgagactttaaagacaagtagaaaatatttcctctgacttacagcatggacttaagagaaaaatttgaatttagttacctgaacttgta

SEQ ID NO: 14771 - DNA, 533 bp, Homo sapiens
gtacatggctgttgacagaagacctcaatttcttactagctgtcagcagaaacctttggtttctactcatgtggacccctccatagggttgctggagtgttttcacaatgtggaagttggcttccttcagggcaagtaatctgagagagagcaagaaggaagtcataatgtcttttataatctggtcacacatagtcacatcctccatattctgttccttagaaacgtgttgctaagtgtaacccataattaagaggggattaattagactctacctttgaaaagaggagcatcataaaattcgtggatatatttataaccaacacagaatgggacagtaatttattattcccccttggacctgaccaaaataggttattttctctctccgcaaaatacttttgtccaaatggaaataaattcagccctccatatctacaggttcacatccatggatgcaaccaaccatggacagaaaatatttgggaaaagatgttgcaaaaaataataataaagaattttatatttggaaa

SEQ ID NO: 14772 - DNA, 526 bp, Homo sapiens
atctcaacttagtataatacccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaatttacacccatagtaggctaaagcagccacaatt

SEQ ID NO: 14773 - DNA, 362 bp, Homo sapiens
ataatatataaagtaaccagtcttcctgtattttatgtgcatcatagtgatttatctgagcttagtgacccccatcttgtaacctgttgcaagagtgaatgtaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgaccaagatccctccttgcaagacagatgggaatgtgtataataactaggtatttgagaagttctgaagtttgatgtaatctgttacttgtcctgttaaaaaaaaaaaaaaaa

SEQ ID NO: 14774 - DNA, 304 bp, Homo sapiens
ctcacaccattttgctggacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctggg

SEQ ID NO: 14775 - DNA, 425 bp, Homo sapiens
gctagcttcttcctaaacaaaatctactctaggaagatggcccacctggatgatggttccaggagggccagctcccttattgctttgctttctcttcctcctcttctggtaccttggggaactgatcacaaagagccttttgagggtgatggaaagctacccctccattcctcaggcagttttccaaagatgacacttggctaaatgctcagggtatttacagtcataggagataaactatcaacttgttactgttaaaaaaatcttgagatctgggatcttgatgcctgaaaatcccaagattggtacttggcaaactgaaagaaatctagaaaaccctagagatcaggcatctgtggccagctaactggtcatacaaatggattgttgtggtgaacttgtatagtattaatcctgagatgctg

SEQ ID NO: 14776 - DNA, 540 bp, Homo sapiens
ggctgaaaaatgattatcttaaagtataggtgtgaaggatcaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccatttcagccacatctaaaagagcacagtttatgtggtgcggaattaaacttccccatcctgcagattatgtggaaatacccaaagataatagtgcatagctccttcagcctctagccttcactcctggctccaaaagctatcccagttgcctgttttcaaatgagggtcaaggtgctgctttgcatgcctgccacccatggaagtggttcccact

SEQ ID NO: 14777 - DNA, 480 bp, Homo sapiens
aacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctggcagaccttatccaagtctggtacaactgtccttagactgatgagc

SEQ ID NO: 14778 - DNA, 457 bp, Homo sapiens
aacctggttttatatttcttagaaaaatttgatatttttctctatatgttattcacatatttttgttcatggtctattttttagttttcttcttaattatattttttgaattgttactcctagtttattagatgtattttggatttgtaaattagtttttgtattcattaccttaataagtttgtttttaaagtctaatggcattttagtattttttctttggttttctagatagactgtcaatcttaaacataatgataatgttgactgtacagtctttacatcttttgtgtcttgtcttattgcattggctagaatgaggttaaaaagtaattagcacagtaggcacacttattatgatctttaaaaaacatactattgaaaatgcctctaatacttgtccataaggggataatggttggtcattctatagcggtcttcagggagggctcatcta

SEQ ID NO: 14779 - DNA, 205 bp, Homo sapiens
cgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtcttttttttttt

SEQ ID NO: 14780 - DNA, 218 bp, Homo sapiens
ggaatgttttcaataaaagatgaagaaaatgtgtgtgatctttaataacacatccctatagaaagcggataaaagatataccaaaactgtaatacagatatatacaaatataggtgcctttttgattactcttgtttgtctagtacggtcttggaaagaaaaccaagcaagcaagttgctgctattctatagtaatattttattacacatgattgata

SEQ ID NO: 14781 - DNA, 378 bp, Homo sapiens
acgaggagtgaagtctgacaacatctccacaatacaggttacttggcatgcaatctaagaataaagacaactataatccagaggaaaagcagtcaacagaaatcaaccgtgagattactaaaatgtttgtttcatgggcaagagctttaaagtagctattaaaatcattttcaagtattaaagatgaaaatgagggaaaaatgggaactatcagcatagaaatggaaattaaaacacactactaagtggaaattccatatctaaaatgtcctatatctgcaatggataatttgctggataggctgaaaagcatactggtgatggcagaagaaggaataggtaaccttgaagatagaagaatagagattacgcaatctg

SEQ ID NO: 14782 - DNA, 409 bp, Homo sapiens
cattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtaaaaaaaaaaa

SEQ ID NO: 14783 - DNA, 210 bp, Homo sapiens
tcagcattatgaagggaaaatttgaatactagaggttctctgaggactgagggatggaggcacacacacactgatcctcttattgtctccccaaagacatccaacagatataacaacattatagcgaaaaatcttctcagaaattagaaactatgacggtatcccatctgtctacctgaaagttagtgtagagtgatgtgccaggagccc

SEQ ID NO: 14784 - DNA, 424 bp, Homo sapiens
tgctgggaagagaggcgaagccaggtcacctttcaaggacccttaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaatgccaa

SEQ ID NO: 14785 - DNA, 466 bp, Homo sapiens
caggcaagggaaaactgaataggagcgaatggattgctagggaaaaaacaaaaaacaaaaacaaaaccagaaacaacaaatgtagaagttaaaatcgatatataatatgggaatggtctttctgttgtttataaaatgtctacacaatttattaatttctagaaaattattttttagaaaagttctgtgaacttcagtggactcttaaaaattggagtttagcattagctagaaactggcatatttgttttagtagcacattcttattctggctccaaatatttacaaagagcaaagacctccatgttaatgtggtttcttctctttatataaaagttttattggcagtagttcatgatggttacagtgcatttccaatataattatattgaccatagagaatgcttgggtgccaaatggtaaaaaatctaaatttgtaataatatgtataccttgggaataattc

SEQ ID NO: 14786 - DNA, 316 bp, Homo sapiens
gtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgcactgaaaaacattttattaataaagaatattgacatgaa

SEQ ID NO: 14787 - DNA, 588 bp, Homo sapiens
catactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgccagtgcttttcctgtggagggtgtttagagaaatggcaggaaggtgatgacccattagacgatcacaccagatgtttcccaaattgagctttatccctcctcggatcaggctatgaaggatgagcttcatgcttcatccctttgctcatgacccctttctgactagccttccctcttataggtatggcatagttggctagatcatatatcacatactgttacattatcatgactttccaatctatgtgaaaaaaa

SEQ ID NO: 14788 - DNA, 304 bp, Homo sapiens
gggatattgatatttgatcaactgttactagatgtggaattaagatttggagattatcgaactttaaatactgttaaatatggcagcctgagtaaaaatgtaaatatgaaaatcttacaagagctaataatttatgtctgtgtgaatgctcatgtttgcattaataaaggttttatttagtaattgattttccctgtctgccttggcactatgtaggattaatcgttttgcctatcctcgatatggtatagattgtgaagcacattttctaaaacataaccaaaaaaaaaaaaaaaaaaaaaaa

SEQ ID NO: 14789 - DNA, 386 bp, Homo sapiens
ggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaagcactgttgaacacaggattctgttgttagtgtggctgttcaatgagttgtattttaaatatcaaagattattaaataaagataatgtttgcttttct

SEQ ID NO: 14790 - DNA, 504 bp, Homo sapiens
cataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttccaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtagcctaaaatgtgtcaatggtccggttta

SEQ ID NO: 14791 - DNA, 442 bp, Homo sapiens
tatgccaaacctgcaaacaaacaggaagatgaagtgatgagagcctatttacaacagctaaggcaagagactggactgagactttgtgagaaagttttcgaccctcagaatgataaacccagcaagtggtggacttgctttgtgaagagacagttcatgaacaagagtctttcaggacctggacagtgaagggagcccgggcagccaccgtctccagagccctgggcagcattttccagcaagatgtacacaatcttttgcctttatttcgtaaagttttatacagaagagagaagagcatgtctttacttgaaaaactcttgatcaagaatttgggtgggagaaaagaaagtgggttatcaagggtgatttgaaattttctgcagcattaaagctggcgcttaataagaataagtaataataaagaaatttctaacatcca

SEQ ID NO: 14792 - DNA, 533 bp, Homo sapiens
atttaatttaattttgctgcaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattgtatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggctagtagctacaaatattaaaggaggagaaaagg

SEQ ID NO: 14793 - DNA, 575 bp, Homo sapiens
ataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacgggcgaagttgcctcttttaggaatctctttggaattgggagcacgatgactctgagtttgagctattaaagtacttcttacaaaaaaaaaaaaaaaaaaaaaaaaaaaaa

SEQ ID NO: 14794 - DNA, 392 bp, Homo sapiens
ataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttcc

SEQ ID NO: 14795 - DNA, 309 bp, Homo sapiens
attgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaaccaaaaaaaaaaaaaaaaaaaaaa

SEQ ID NO: 14796 - DNA, 501 bp, Homo sapiens
attgaagttaaacacaaaattatcatgtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatcaaaaaaaa

SEQ ID NO: 14797 - DNA, 364 bp, Homo sapiens
gattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaacagcttaaagtttagtttaaaagttgtaggtgattaaaataatttgaaggcgatcttttaaaaagagatt

SEQ ID NO: 14798 - DNA, 547 bp, Homo sapiens
gggagggacagcattaggacaaatacctaatccatgcggggcttaaaacctagatgatgcattgatagatgctgcaaaccaccctggcacatgtatacctatgtaacaaacctgcacattctgcacatgtatcccagaacttaaagtaaaataacaacaaaacaaaaaatgtgcaaaagatttagcttcacagaagaagatataagaatgtgaataaccacttgaaaagttgttaatgttattagtcatgaataaaatgcaaattaaagctaaattgaattaccagtttacatccactggattggccaaaaattaaagattcatattaccaagtgctgcagggatccagagaaactggaacttttatactttgctggtgaggttgtaaaatagtataaccacatggaaaacagctggcagttcaaataaaggtaaaaatatctataccattcaatccagaaatgtccttctatgtattacccaagagaaatggaacatattccaccaaagcctgtatgcaagtgtcatagtactctatttggacctg

SEQ ID NO: 14799 - DNA, 247 bp, Homo sapiens
aaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccg

SEQ ID NO: 14800 - DNA, 188 bp, Homo sapiens
caacccaattccttggttcgttcttctcccccagtactagatagccaagttgggtggtaggaaggaagaaaatatgcagcaagtcgagtctagttgtcatgctcctttggaccagaaaggaccttaaagattgtctcgtcatgttgttcctataccttttgttttcgtctacctgtaaaaaaaaaaaa

SEQ ID NO: 14801 - DNA, 415 bp, Homo sapiens
ttgtttcttgggtgatttcaatattcactagaacagtgcttctctctgtaatctggaaagcaaatacaaaaacctatgcaagggtagctgtgcaagatttgtttcttggtcccagattaaacgcactgaatcagaactctgaggggtaaggccttgaaatcggcgtcagagtggttctctgaatgattcttgttcacacttaaattttagaattactgcattagagacagatggcagaatcaattatcttttcaagtttcagctgtctagcctactacaaatgcatgaaatgaagtcattactgagtgtctacatggtagaaattaagccaaaattcaatatttatataaaattatacttttctttaaatcatttacagttattttcatggacatatctaatcttatattgagag

SEQ ID NO: 14802 - DNA, 195 bp, Homo sapiens
aggcttacttcattgattccaaacactctccatggaactcattcatgaggttctagcgagggatgattttatcagcatttaaaacaggaagttagtgtcttcctcagtcccatctctgtcattcattgaacctgggcaaattccatgccttcccaggtgtttcctactcatcaaacaaagcattagggtaaaagg

SEQ ID NO: 14803 - DNA, 112 bp, Homo sapiens
aaacagagggaaaacatgttcagggcttcgagaacacaaagaaaattggcgtaaaccagaggtcagattggggccaaactgcgaatggaatacaaattcacataatctgaac

SEQ ID NO: 14804 - DNA, 519 bp, Homo sapiens
gggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttaagaagca

SEQ ID NO: 14805 - DNA, 474 bp, Homo sapiens
catgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatc

SEQ ID NO: 14806 - DNA, 504 bp, Homo sapiens
gaatgggagctggtgaatgatgatcaagaaccagaggacatttacgacgatgaagatgacgagaacagtgagaataactggcgcaatgagtacccagaggaggagagcagtgatggagatgaggattccagaggctctgctgactacaacagcctgagtgaggaggaaagaggcagcagcagacagcggatgtggagcaagtaccctctggatgtgcagaaggagttcggctatgacagcccccacgacctggattcagactgatggtcttgtgatgtccatgaggttctgccacatgcccttgagggctctgagtccagagttaactgccctgctgacatcctgttaggtttcctagcttaacatgtggaaggaaaagcatatcaagcatatcgggcggcaccatcccaccacagtgaaaacttatgttaggggagtgagtcttttccacttacagtaggacccctttgcctcaatcaaaagtgaccctacagtttgaaaaaa

SEQ ID NO: 14807 - DNA, 493 bp, Homo sapiens
agggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcctcctgtaagaccttcgggtcaaggcagaggcaggcaactaactggtgtgagtcaaatgccccctgagtgactgccccag

SEQ ID NO: 14808 - DNA, 560 bp, Homo sapiens
aactcttagcagacatttactcattctttagacactagtaccagcattgtcttctcatggagtcatcttgggccaccctaaatcaaattctttcttcagaggttcttaagcaaaaattcacctctttgtcttaattatatcacattgcagttttgtacttggtgtgtgtggctatttggttgacatatacttctcatagacccttaaaatagggaccatgtatgtccaaggccttattagcgccaggctcacagtagacattaaatactttcatgcatttttttaaacaaggaggtacattaaattgttggattctttatttccactctcttgaatgtgagaaataaaaggctcattttcatcttttctttgaaatagggtagttttttctggatataatttcagttaactcatagacctaaatttggtgtttagcaatcttttacacaaatatatgtgggtgataatgtgtcagaatgaagaactttgaaatttctgtgcagaatgtctcagcatcatccttggatgtgatgatggacttgggggctgttctgtatgat

SEQ ID NO: 14809 - DNA, 628 bp, Homo sapiens
gggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaggcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattccctgagtgaaaagttggaacgcatataaatctgctaaattttgtcctatccttttgttaccttatcaaaatgaaatatacagcacctagaaaataatttagttttgctgctcatgatcagtctttactgaggcattaaatatctaattaaa

SEQ ID NO: 14810 - DNA, 366 bp, Homo sapiens
atttctgaaagccatgaacctctacacaagttcatttgtggaattcctttaagataccccctgaaggccgggcgcggtggctcatacctgtaatcccagcactttgggaggccgaggcaggcatatcacctgaggtcaagagttccagaccagcatggcaaaaatcccatctctactaaaaatacaaaaattagccgcgcgtggtggcaggtgcctgtaatcctagctactcaggaggctgaggcaggagaattgcttgaacctgggaggcgaaggttgcagtgagctgagatcccaccattgcactccagcctgggcaacaagagcgaaactccctcgaaaaaaaaaaaaaaaaaaaaaaaaaaa

SEQ ID NO: 14811 - DNA, 227 bp, Homo sapiens
gtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaaaaaacaaaaaaaaaaaaaaaaaaaaaaaaaaaa

SEQ ID NO: 14812 - DNA, 274 bp, Homo sapiens
ttccagcaggacccacggagtaaattgttgtaggagaatgctcttagatatctttagccacctagtaattgcacagcttcttttatgcagaggaacgagaggtatgatggggggagggaccctaagtgttttttcagagtgggctttcttcctctcctctcatcggaaattaaaatgaagattgccattgtaacacacatttaagatgtagccgtgatgcctgccaatcagccggatcctctaaaaacaaaaaaaaaaaaaaaaaaaaaaaaaa

SEQ ID NO: 14813 - DNA, 385 bp, Homo sapiens
tgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtctcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattcgac

SEQ ID NO: 14814 - DNA, 338 bp, Homo sapiens
taatgtagaagaacttttagggtttttggaactgtacaattcttcagctacagattctgagaaagctgtagaaaaaactttacaggatatggaaaaaaaccctgaattatctaaggaaagggaacctgaacctgaaccagtagaagccaactcagaggaaagtgatagtgtattctcagaaaacactgaggatcttcaggaacagtttacaactcagaagcaccactcccatgcaaacagccaagcaaatcatgctcagggagagcaggcttcatttgaatcttttgaagaaatgctgcaagataaactaaaagtgccagaaagtgaaaaaaaaaaaa

SEQ ID NO: 14815 - DNA, 595 bp, Homo sapiens
aaccttgtataaagaggacgaaagtgtagaatgcagaaaaaaacattaaccctcttgtggacagtcaggattgaaaggaagaaaaaataatggcttacacttctagaatgctttctatgtggcagagacagttctaaatatttacatatcgtaactcattcacctctatgagataggagcaatgactatctccgttttacagatggagaaactgagtgcagagaagatatagaaattgtccaaactcacaaacaactaattaaggtcacagctgagattcaaatgcaggcagcctggctccagagtcttctcttttaatcattataccatgctgccatctcagttttattttaaaataataataggtaacatttattaattatttactatgtgctacatattgtgctaagaactttatataccttcatttcgtcctttcagaaaaggaacaaacagactgggtgcactggctcacgcctgtaatctcagcattttgggaggccaagcggggacgatcacctgaggtcaggagtcaagaccggcctggccaacatggcgaaaccccgtctctactaaaaaatacaaaaattagcca

SEQ ID NO: 14816 - DNA, 332 bp, Homo sapiens
tgtgatgtaagcgtttcatctggtcagtggttcctttgatattgtactgctgctgggagtgggctgaggaacctgccttcgggtaactgggttcctcttgggtagattggagagatgggggcgggcgtgggcaaattctcacacatgttttcttaacctatttgcagaaactttcaaaaggcatttgattaaacctcttggcagtacagtattcttgtatttgctaacgtctgcgtttaggtaccggtacctttttgttttaaaatgttctaagtgttggctttaaagcgaatttatctttagtatgatagttatatgaaaattataggatt

SEQ ID NO: 14817 - DNA, 382 bp, Homo sapiens
attccaaaagtggagtggtaggtgttccagacagagtgctgattcaagagtgagtaggggtgtagggtgaaagttggccactaattcaagcctcacctgaggcagtgttgctcaaacagaaaagtgccctctctaattagctgcccccatatgcgcttagattaatgacagccaactaacttagaaaccccttccagagtaagctagccaaacaatagatgttccatggacatgacaaagagctaattttcttgtgctaaggaatttttagctcttgtatttgtggtggactgcctcatcacctaatgaaggtgaagtacattctccattttaggaggcagagttaaaacattttcctcctgtggatgtctgattaggaaaa

SEQ ID NO: 14818 - DNA, 199 bp, Homo sapiens
gtgaagagctgttttctgttttagtcaatagttttaggctgagtgcggtggcttacacctgtaatacccacagtttaggaggctgaggtgggaggattgattgaggccaggagttcgagaccagtctggaaaacaaagaccccatctctacgaaaacatagatagatagatagatagatagatagatagatagataggt

SEQ ID NO: 14819 - DNA, 414 bp, Homo sapiens
actcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggttctgcttcaataaatctttggaaaaactca

SEQ ID NO: 14820 - DNA, 432 bp, Homo sapiens
aagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacat

SEQ ID NO: 14821 - DNA, 250 bp, Homo sapiens
ggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttttgtt

SEQ ID NO: 14822 - DNA, 565 bp, Homo sapiens
cagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggctggggcgacctcggagcagaacccaacctccgagcagtacatgctaaggcttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagccctacgtgatctgagttcagaccggagtaatccag

SEQ ID NO: 14823 - DNA, 567 bp, Homo sapiens
caaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactaagtataaaagtctacaatctaattaatagcaatactagatgtttattattagaaaagattgctgagagtatttatcaggttttacaaagtcattttaagaaagcaagatactgatgttaacagaataacatttttggggaagctggctcc

SEQ ID NO: 14824 - DNA, 382 bp, Homo sapiens
ctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaatggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattat

SEQ ID NO: 14825 - DNA, 724 bp, Homo sapiens
acggacccgtccagattacttcccactctactctggctgagtttatgctacatcgagtcctatcaaggaatgaaactccatcattctgaaatgtctgagcacagcccgagggtctccttgtttgtaacctcatggggatcacctgcaaggactccccacactccagaccactctggccgttttactaatattgccacaaatgtgacaaaatctaactgctaatggattatcaaatgaatgaaagatatggaaaagttcacagaacagactggcatggcgtgtcagcagcgttctcctgatagcacatcacaggatttgccagtggagacagtgattattgcagtgctcatctcaatggtcagccgtaaactgactctcagaacagaaaacatgcaatggcctggccttctctgacctagtggagtaagcgaagatggcctcccaggaagcaattgccaaaatgtcctgtgggagggttctggtacagacggggagggccttagtttgccacagaatccacattctctgcctaggaatatctcctaagcacctagaaatgcagataattatgaatgaagactgcattggggggttcacaataaagttaggaagcttctgcccccaacagggagcgggaaataaatatgaaggcccggactaaatcctgggaagggataggctacaatggaacgtctacccgaaaaaaaaaaaaaaaaaaaaaaaa

SEQ ID NO: 14826 - DNA, 267 bp, Homo sapiens
attgtaaattttaagtcagtctctgtattagttaggatttggtttaactacaagtgtcagaaaatccaaattaacagtgacttttgattttaactcaatatatttagtaatcaaataaaagcaaactggccgggtgtggtgcctcatttgtataatgccagcactttgggaggctgaggtggatgattgctggagcccaggagatcgagaccagcctgggcaacatggaaaaaccccatctctacaaagaattaaaaaaaaaaaaaa

SEQ ID NO: 14827 - DNA, 428 bp, Homo sapiens
ctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgct

SEQ ID NO: 14828 - DNA, 365 bp, Homo sapiens
ggaaacaatcctgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttaacacttccaaa

SEQ ID NO: 14829 - DNA, 489 bp, Homo sapiens
ggatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcacatacggctctaacagattaggggctaaaacgata

SEQ ID NO: 14830 - DNA, 407 bp, Homo sapiens
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggagcagctctttggacactaggaaaaaaccttgtagagagagtaaaaaaaaaaaaaaaaaaaaaaa

SEQ ID NO: 14831 - DNA, 95 bp, Homo sapiens
cagggaccatggatgttaaagagctgagatcttaagctgaataggaagtagctaggtaaaagggaagagtgaggttgagcagaagtgttttgagc

SEQ ID NO: 14832 - DNA, 425 bp, Homo sapiens
tttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagttttgacaaacgttcttgtctaccccagtagtcacagatgccatctttgcaacagaaagagtggtggtggcaaaatttctagaatgaatctaaaaaaaaaaaaaaaaaaaaaaaaaa

SEQ ID NO: 14833 - DNA, 254 bp, Homo sapiens
ttttattgaacttgctcctactcctcttgagcttggcgtacgcataggaatgtttatcttacctgttttaagtgacgtttacttggaagcatttgattagtttataaatacatggtgtcatagtattggtttgtgtcaggaagacttgcttaccacaaagcagtgaagtctcagtggagagctggcccctggtctacagagtgacccagagctgggtcatggctggttcaagagcgtctcacattcgctgtcta

SEQ ID NO: 14834 - DNA, 324 bp, Homo sapiens
cctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggtttaaaaaaaa

SEQ ID NO: 14835 - DNA, 183 bp, Homo sapiens
gaaatgaaggaaataaaaaagtctcgatttaaattcttttttaaattttcttcagttggtgtgtttttgggatgtcttatttttagatggttacactgttagaacactattttcagaatctgaatgtaatttgtgtaataaagtgttttcagagtacaaaaacaaaaaaaaaaaaaaaaaaaa

SEQ ID NO: 14836 - DNA, 127 bp, Homo sapiens
ttaagacatttccagatatataaaaactgggagaagttaatgctagccaatatttcttgctctacaatagatattaaaggcagttctttagattgacataaaaaaaaaaaaaaaaaaaaaaaaaaaa

SEQ ID NO: 14837 - DNA, 504 bp, Homo sapiens
agggcccttagcatacaaatactttttcaatagatggttgcctaattaagttgaggtataagggattagataattcctgacacttgttaaataaaggtgagaggagttcatgaagtcagctttaaggcagttacccctgattagggccactgggcactaagctttctgggtaagagttgcagccattcattgtggttttaccatctctcctgaggagctactggtgataaactacatattctccctctcccagtcagaatgccttttcttttgctttattaagaaaatccatcgtggaaattataatgggaatattctgtgacaataaaatgagagcctataggcaatatattctatactatcattttttcattattacaacccataatatttatttagtgaccagagactaaagccttactaactttgttttaaagatcttgaaaggtggtaaggtgatatattcaaatagtgaataagaagaaacttgtccaatggagctgc

SEQ ID NO: 14838 - DNA, 265 bp, Homo sapiens
tgtctttttaaaaccttataaaagatttaattatcacatttattcttcaatgtggaaatattaaatattgttggttgtaaaataatatttatgtacttacttgtgtctgaaaagttgtaaaatgcttacctcagctatacaatatccgtgactctgaagactttaatgagtactatttcattaacaagaagtcagaggcaaatagaggaacaccattatcttacttccctctagaatactgttgaaacatttgaaaaaaaaaaaa

SEQ ID NO: 14839 - DNA, 470 bp, Homo sapiens
agcctgggtgatagagcaagattctgtctcaaaaaaaatataaaaataaaaaatctgtaacccgccacatcaacagcctgcagaagaaaaccatatcatgtcaattgatggacaagaagcatttgataaaatccaacacccattcatgataaaaccgagcaaactaggaatagagaggaacttcctcaacttggtaaaaaaaaaatctacaagaaacctactgctaagagcatacttaggggggaaacactggatactttctccctaagataaggaaacaagatgtcctgtctcttcactcttactcaacatctcattggaaatggtagggaatgccataagacaacaaaataagaggctccagatgggaaaggaagaaataaaactttcttcggacaggcatgattgcctaaggagaaaatctagagaacccccaaaactattaagtctttgagcaaagttggaggata

SEQ ID NO: 14840 - DNA, 110 bp, Homo sapiens
tgcttgctcaggattaggtagaacctcacgggtcagaaaatccaaaggaacagtgacttttagatctgaactcaatatatctaggaaacaaataaaagcaaactgaacgg

SEQ ID NO: 14841 - DNA, 350 bp, Homo sapiens
aaacagttattttttgtaacaatttttaaactattaggctttatacattacaaaatctttcgatcttttaaggtagtaaaatgtgcccagagtgtagtgctgaagtattctgcagtgatgttgaaaaatgtgaaacaccttttatttggcatgttgtctaaatgctgcctgaccccgcagttcttgcagttggtgcatcatctgaatgctgtctaaccctgcagtttccagaaacatgagatgataatttgcttctttggtgagcctgtggcttaggtccatttcttttcacaaaaaagaatgatcagagaagacttaaatgccctataagtcatttcagaaacattacg

SEQ ID NO: 14842 - DNA, 474 bp, Homo sapiens
ggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcctctgtaagcctgtctgagtgtatgtggaaacgattgtcaaatctaaaatatctatatattaaaaagtagggaattgtcctagctc

SEQ ID NO: 14843 - DNA, 205 bp, Homo sapiens
atacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaaaaaaaaaaaaaaaaaaaaaaaaa

SEQ ID NO: 14844 - DNA, 141 bp, Homo sapiens
agtgctctgaattctgtggagcaaaccacagtttcatacccatcgtcctagaattaattcccctaaaaatctttgaaatagggcccgtatttaccctatagcaccccctctaccccctctagagccaaaaaaaaaaaaaaa

SEQ ID NO: 14845 - DNA, 225 bp, Homo sapiens
gagatacagaaaccgacaggggccaggcacccggtggctccgaagcggggaagtgggacaagatggtttacatctcgaacggataagtgttggacagccggagtcagtctccatggagattatctttgataacagatttcttctggggaatagctgagtttgtggttttgtttttcaaaactctgcttcagcaagatgtgtaaaaaaaaaaaaaaaaaaaaaaaa

SEQ ID NO: 14846 - DNA, 385 bp, Homo sapiens
gggtaactaaaaacgcacaaacagctatagagtatatatgaaaggaagtgagaaagaaatttaaatgtttcactacaaatagttaactaatcacaaaataagacaggacatgcaggaaatgagggacaaagtccttataagatatgtaagaaataaatagaaaaatgaccaaagtacatcccttttatcagaaattaatttaaatgtaaatagattaatctctccaattaaaagacaaagaatgtcagaatggatacaaagtttaactatatgatgtctacaagagacttgttttagatcttatgtaacttgtgtctaaaggcaaaagtagcttgaaaggaaagaatggaaaaagattccatgcaaaaaaaaaaaaaaaaaaaaa

SEQ ID NO: 14847 - DNA, 452 bp, Homo sapiens
gatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgagga

SEQ ID NO: 14848 - DNA, 271 bp, Homo sapiens
gaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtataaaaaaaaaaaaaaaaaaaaaaaaaa

SEQ ID NO: 14849 - DNA, 525 bp, Homo sapiens
tacatcctctgtcagttttctatcaaacattctaaatctctgcttttcttgagattatattgtttagctaaattcttataattacaaatcaaatttatagcttgtgacataaaaaaacgagcttcagcaaactgttctgagataaagctgcagattttaggctggaaatggatgagaccattaatgtagctcatgatttctcaaagttgacatttggacttgttaattctttttttgtgtgaggccgttcagtctattggaggattagcaacatccctaagtccactcagtaggtgccagtagctcccccaaggtgtgacaaccaaaagttcctctagacactgccaaacatactttgagggtcaaaaatcacagctagttgagaaccactgatgcaactaaagtactacatctaaagtactagttcattagtaggtgactgtgcatattttcaagtgttctaatgtattgacagctagaaaatataatgaaaataaagcaactgggtcgttgggtttgctatga

SEQ ID NO: 14850 - DNA, 270 bp, Homo sapiens
agcaaaggaacgagtgaagtctgtatttcatgccagagagcccggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaac

SEQ ID NO: 14851 - DNA, 412 bp, Homo sapiens
acagggacttcagagattgcaccgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgtgc

SEQ ID NO: 14852 - DNA, 486 bp, Homo sapiens
attctaagtttctctgggagtccgagaataaccacataaccttcgtttggttatctcatgcagaaaacttgaatcctactcagtgattttgaaatgacctttgtcttcaagcaaattttgaactcacagatcctctgccacaataagtcaattttaaatctggccttgtgtgccatagctgtgatgatcaactctgatagcatttctccaaggataaccaaggatgacagagccaatattagcaaaatagaaattttggaataagaggaataagctagattattataacatttctttctactctaaatcaattaaaaagcaagaaccagatatttaagtttattcttggtcaacatcggagactagttaggaaatatcttgcctgtatttctcggtgctgctattgatcaacctaagttttattcttagtcaattaaataactattgtatatttaaatacttatctacggccacagggtttttttt

SEQ ID NO: 14853 - DNA, 560 bp, Homo sapiens
ttgaggcagccagcgcaggggcttctgctgagggggcaggttggagcttgaggaaaccgcagataagtatatttgtctttgagagatagagactagtacaactacttaaaaaatatagtcaataggctactaagatattgcttagcgttaagtatttaacggaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagttaagtttaaaagttgaaggtgattaaaataatttgaaggcgatcttttaaaaagagattaaccgaaggtgattaaaagaccttgaaatccatgacgcagggagaattgcgcatttaaagcctagtaacgcatttactaaacgcagacgaaaatggaaagataaa

SEQ ID NO: 14854 - DNA, 406 bp, Homo sapiens
atcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaatag

SEQ ID NO: 14855 - DNA, 462 bp, Homo sapiens
tactgaatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgtggcaggggcttgtgtgctagccgttagcactgactgccagtatctgttttatcttgctgg

SEQ ID NO: 14856 - DNA, 202 bp, Homo sapiens
gggggggaggccgggggcatgtgccatttccccctccctcctggaggacagatctcagatctggctgtctctatgcccctcacagctatggtggccttgggaaagtgcctgtccccttagctgccccagggatctggactatgtagatctattggcactttttgtaaaatgagatagaagccaactccatgggtattatact

SEQ ID NO: 14857 - DNA, 465 bp, Homo sapiens
tcagggatgccaaggcaggtaaatatatttgcagcactggaaagaatagcttttcagagggagagacagacagacagagagaaaaactaactctttttcactagaaatctgcagattgtgttcatcaggtcttttctgaatactaatcagtgcatatgtatgtaaactaccaaagccaggtaaggaacctttggaaaagagctaacaggaacaataatcctcagttctcacctgtgctagaaatactttctgttttcacaaggcagaatggaggaactcgtaacatgtagagggtagggttgtatcttcaggaagagtattgcttcagttgtggaaccaagttaattttagtctaatagctattccagaccagaccttaaaaacaggtataaagtaagacttgaaaggatgaaattgtttccagataaattcagtgaaccccagaacaaccccccaaatagattc

SEQ ID NO: 14858 - DNA, 614 bp, Homo sapiens
  misc_feature 598: n = A,T,C or G
ctccagccatgcttcctgtacagcctgcattaactgtgagccaattaaacctcttttctctatatattacccagtctcgggtatttctttatagcagtgcaagaatagactaatacagggttcaattcagcaagaggatataacaaatataaatatatatgcactcaacactgcagcacccagatatataaagcaaatacgattagagctaaagagagagagtaaccccaatacaataatagctggagacttcaacaccacattttcagcactggacagactttccagacagaaaataaaagagaaacatcagacttaatctgcactgtagatcaaatggatctaatacatacttgcagaacattttatccaatggctgcagaatacacattcttttttagcacatgtatcattctcaaggatagaccatatgttaggtcacaagtcttaaaacattaaaaaaggtgaataccatcaagcatcttctctgccacagtggaatcactagaaactaataccagaggaattttggaactaccaatcatgaaaataaccatatgctctgaagacccttgagccatgaagaaataagaagganttggacattcctgaac

SEQ ID NO: 14859 - DNA, 512 bp, Homo sapiens
ttaagtaggttatggcaataatcatcatgatagtagttaacaaatactgattgcataatgtaactctaactatttttacatttattttatttaatcttttttcaacatttttctgtaatatatcacttgtgttttatttccccaaatagaccaaaagtaacttatttatctttctattcctagtatatggcactatacctgggcatatgataaatgttcagcaaactggtagaccagttttaggaagggcactgtggaacttggaggtttagaaatagattctattgaaacatctgtatctgcattaccatgaaaagtcttcctttacgttttcttgaagactgctagaaaaggttgtggctatgtaacaataggcataacacactatgttgcaagataaattgactgtgacaccaagaatatactttatgggcttcgatgaagtacactggaccctctctatatcttacattcgagggggtccaagcattgcagtcccatgctaccaattc

SEQ ID NO: 14860 - DNA, 361 bp, Homo sapiens
ggaaagggtcttagtcactgcctcccgaagttgcttgaaagcactcggggaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaa

SEQ ID NO: 14861 - DNA, 224 bp, Homo sapiens
ggacaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgacttt

SEQ ID NO: 14862 - DNA, 431 bp, Homo sapiens
agtgcctgcattcccaggaaaatacgaaaatcccatgagataaataaaaatataggtgatgggcagatcttttctttaaaataaaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcatccatttcttttatacctttcctttttggggagttgttatgccatgatttttggtatttatgtaaaaggattattactaatt

SEQ ID NO: 14863 - DNA, 650 bp, Homo sapiens
gttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgcttgttcaacgattaaagtcctacgtgatctgagttcagaccggagtaatccaggtcggttctatctacttcaaattcctccctgtacgaaaggacaagagaaataagggctacttcacaaagcgccttcccccgtaatgatatcatctcaacttagtataatacccacacccacccaagaacagggtttgggaaaaaaaaaaaaaaaaaaaaaaaaaaaa

SEQ ID NO: 14864 - DNA, 527 bp, Homo sapiens
cagagcagtcggtgctgtgctggaggcgttataggtattgtgagtatctctcttcatggtaagtagccataatataatgactcataggattcttctctccaaagaacactgtgctgagagtcaagttatcggctctggttttagtcatctaatttactctataatttcctacaaaattagaatgtacttgtcccatttccctcactaggatgtggtaaagaccaagaacataaaagcacttgtagggggagtagacatatgaagccactcaaacacaaccgattgttattgttgtaatatttaaaggataaggcattacatggtgatcattagttcccatcataactgtgctatttccatcaccttatttctctctcattatccttttagttttatgtctctgcctgccagtaaactaatcccaatgtgtattttttaatggttggcaaaaattcaaaaatgttcttgaaaagaaggaaggccatagaattgccaggattataactatgtattcagtgcaaaaaaaa

SEQ ID NO: 14865 - DNA, 255 bp, Homo sapiens
tccatagactaaaatctgagaattttttaacatatgcaagtcagccaaacataagctaccaaaataaagagcgatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattgggaaaaaaaaaa

SEQ ID NO: 14866 - DNA, 306 bp, Homo sapiens
ataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggttaaaa

SEQ ID NO: 14867 - DNA, 522 bp, Homo sapiens
ggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttaagaatcttgaagaaatttttgacacatcagtttccaaagagattagtgatgacattacttcagacattacatcgtgggaagggaatacacattttgaggagtattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagta

SEQ ID NO: 14868 - DNA, 177 bp, Homo sapiens
atttatgggtgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagc

SEQ ID NO: 14869 - DNA, 269 bp, Homo sapiens
atcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacgaaaaaaaaaaaaaaaaaaaaaaaaaaaaa

SEQ ID NO: 14870 - DNA, 153 bp, Homo sapiens
cttgggataactataggacatatgggtggggacataatgaactcagacctattgcaaggaaaggacactcccctaacatatttggaagttcacaaatgggtgctaccatagtagatgctttggataccctttatatcatgggacttcatgatg

SEQ ID NO: 14871 - DNA, 561 bp, Homo sapiens
agagctattgaaagccattgcctgtgtggtgacagcttgcagtgcaaagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgccggagaccaacgttgttatcgtcaggagctgtgcaaactgatgtgtgaacggctaaaactcagcacgtggaaagtgcagctaggagtcctgcaatcaatgaatgccttttttcaggggttaatgccttttggagaagaacatgccgatcctgaggctttggctgaaattctgcttgaaacttgtaaatcaatcacata

SEQ ID NO: 14872 - DNA, 393 bp, Homo sapiens
ttcagcacgtttcatctcaagatttatcaagctgtgcagggagatgtggggaagggtattctagagatgcgacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttacaa

SEQ ID NO: 14873 - DNA, 257 bp, Homo sapiens
ggcagatcacctgaggtcaagagttcgagaccagcctggccaacatggtgaaactccgtctctactaaaaatacaaaaattagccgggtgtggtggtgcgcgcctgtagtcccagctactcaggaggctgaggcagaaggatcccatgaacctgggaggtggaggtttcagtgagctgagatcatgccattccactccagcctgggtgacagcaagactccatctgaaaaaaaaaaaaaaaaaaaaaaaaaaaaaaa

SEQ ID NO: 14874 - DNA, 546 bp, Homo sapiens
gggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataagcttaatcgaaccctgaagaagatgggacagagacttgatgatattcacacacattcaggaacctgttttgatgtattataggcaggaagtgttttgctacgtgaaaccttacctagatcagcatcagcctgtcaactcagtt

SEQ ID NO: 14875 - DNA, 184 bp, Homo sapiens
ggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttac

SEQ ID NO: 14876 - DNA, 263 bp, Homo sapiens
caagcttaccagaggacctggggggctggcagagcataagtacatccaggttgtctaccttcataacaacaatacctctgtagcggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatt

SEQ ID NO: 14877 - DNA, 122 bp, Homo sapiens
gggcatggtgattcccacacctgcaactctatttatgtcctcctttcttttcccagctctacctattagctgacttcctagtggtaccagaggcatgatttcactttgggtctggggatttt

SEQ ID NO: 14878 - DNA, 273 bp, Homo sapiens
tgctagagcaagtcccaaaaactaagggacagctaagaagttattatggttgacttcaaaggcctaaactgtgttttttatgtccactaaacaacttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttat

SEQ ID NO: 14879 - DNA, 182 bp, Homo sapiens
gaaaaataaaaactcatgtgttcaatttaagtagatatgccaattaagattatctcaaaataattgtgcggaaaattacaatggtattaaaaatattaatttgaaaagaaggaaataagagtagagaaataaaatagaaaacagacaaataacagagaatatcaacacaggcataagctttt

SEQ ID NO: 14880 - DNA, 149 bp, Homo sapiens
aacttatattacacataaagtaattaaattccctgacagctcttttttagtttttaaaataatggcccgtgttggcagtcccgtattttggaaagggacaaagtcaactttttaataacgggtgtagaactgaaaccctagaaaggcaa

SEQ ID NO: 14881 - DNA, 512 bp, Homo sapiens
gaaatcttcagagaagaatttccctttagttctttgcattatggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggcaccttgaggagggtggtttagctctgctaaaaactccagcgcaatttggatgctgatgaacttcgtgccgccatgaagggccctggactgatgaagataccctaaatgagaatttggctcaagactaccaaggaatc

SEQ ID NO: 14882 - DNA, 118 bp, Homo sapiens
gggatgccagcactttgggaagctgaggccagaggactggaagagccccggaggcagaaaccagccccagaaaataacaagactctggatcctctaagaagaaggaaagttgtaaaaa

SEQ ID NO: 14883 - DNA, 147 bp, Homo sapiens
ttgtatttaaaaaatctattgtttttattgtatattgacattttataaaattttttttaatgggcaataatggtatatatttatggcgtacaatgccatgttctgaaataggaatatatccattactggatgattaaatcaagctaa

SEQ ID NO: 14884 - DNA, 455 bp, Homo sapiens
ttgcaaaaagcggaaggtttgtatggctgcagcaatggcttcaggaatttccttttctttctttacgatatttatgctggattcatttatcttgacatagtgagcaaccacagcagcagacctcaatccatggtgcatatcaagcaattccactttttcttacgtcctgactttggtttcttgggagaacttccggcatcactagtggcacttcatatgggttccatggcttttttttccagagttcagtattgcactaaacatgatgaaaagtatgtgagaaccgcttaagaccactttttactgtgatggggaactcactggagtgatgggctgcacatgcggagatgattagcgccatacttgtgctctgagcagatcaacacaagctcccacaatagcatcaggagatggtgatgaaattattccagtgtacagatgccctaaagtaattt

SEQ ID NO: 14885 - DNA, 560 bp, Homo sapiens
ggcctttctgggggcttataccctgtgtccgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagacatcttgtctttctgagggtagccagctgttttcagtggtccctgggagccagctggagacaggtggtcctgtaaaagctttatcctaatgtgggcacattcactccatgagtcctcaaaaactttttttttg

SEQ ID NO: 14886 - DNA, 611 bp, Homo sapiens
atatttatgatgtatttactctgcgccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagaggccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatgatgttagtgtcgtattttgagctggggttttgagactccccttagagatagagaaacagacccaagaaatgtgctcaattgcaatgggccacatacctagatctccagatgtcatttcccctctc

SEQ ID NO: 14887 - DNA, 353 bp, Homo sapiens
agagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaaggtgcttagatgtatagttttgataaccacagttttaaatcttttatctgtgcataataaaaagatatatatcagtt

SEQ ID NO: 14888 - DNA, 427 bp, Homo sapiens
gtcaaactctgcaaagcaagggagtagagcaaaaagcaatgaagtatgcatttaaaaagctgtatcgagagaacaagcttcatatattgttaatatatttggcaggtcgcatgctgtttttttaatgcagtgttggaaaaacagtgtagttataccatcaggaatatacatatctaaggtccttccgcattatctctacttagaaaatttgtctgtggtatcatgaaatctttgtacaaattagtttatatttaaaatatagattcatgtatttgagataacaggaatttgctatgttaaaattaattttttttacagaataattatgatgtagatttttttatttgattcctgccgcttttaatttaggcacaaagaatgggtattattctctgttctccctctaaagatataaatgttgaaaaag

SEQ ID NO: 14889 - DNA, 532 bp, Homo sapiens
gtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatg

SEQ ID NO: 14890 - DNA, 573 bp, Homo sapiens
gtaagaaagtcattttttaaacaacactcaacgttgtgaacccctgaagattttttgaccgttccaagtcttaatgccacaccaccattccagcgaatttatgctacaactggtaacaatgaccagaagcctgaagaattaaaatgccaacaccaaacctttccttaccagctctggtctatattgctcccatgcatttaatatattattttgtttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaata

SEQ ID NO: 14891 - DNA, 632 bp, Homo sapiens
ctcaaagaggtctcataacatgaaagaatccttaaaagtcccaacaatgtgaccccttttgttctgaggcatagttttcaagaaaaaaatgtcaccttacatttaagcattatatgtgcttgataacctttaaaaagtggaatgatgactcttcctggctccaaaggatcattttttggggacaggtctcagctcattttatttattttcatagttataattcttcctttatgctctcataattttaatgctctaataaataagctgattaggagagtaagtttactgtcactgaaaaccctaacatagagctgggtgaccaacatttgattgattgatattgattgaaaagctctattagggaatctttaattctgtcagaattctgatctttcacatgattttaacctggcaagaggctttaagtaatcagatggtgaatagtcaataacatgctcttgagcaacggtaggtggtgatcagagttgtgatttaaaatgttctatctcagtggctcacgcctgtaatcccagcactttgggaggctgaggcgggcagatcacggggtcaggagatcgagaccatcctggctaacacagtgaagccctgtctctactaaaatacaaaaaatt

SEQ ID NO: 14892 - DNA, 488 bp, Homo sapiens
atactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctctttgtgtttcatgcctgagt

SEQ ID NO: 14893 - DNA, 593 bp, Homo sapiens
atggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagatacgctttgattgctcgatctctggtaaatacgcatcatctgcatggaggatttgatcatgagatctatactgttgggaaa

SEQ ID NO: 14894 - DNA, 415 bp, Homo sapiens
aaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaagtagagcatagattctataaaattctta

SEQ ID NO: 14895 - DNA, 133 bp, Homo sapiens
tataaagaattcctgcaactcaataacaacaacaaaaaatcaaccctatttaaaatgagcaaaggacttaagtagacatttcttcaaggatgatatacagatgaccaacaaaaaaaaaaaaaaaaaaaaaaaa

SEQ ID NO: 14896 - DNA, 571 bp, Homo sapiens
gcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagct

SEQ ID NO: 14897 - DNA, 300 bp, Homo sapiens
aacaggcctggtcacaaaatgtgccataccaaagtcacggtgccgtactgactctcaggtattagggtagccttaccaggtgttaatctttaggatacaattcccagtatatagggaggcatccctgacgttcatcctcatgtggggtgaacagggtatagacagctttgggattcttaggaatcagggttaagcaaccactagtctctttttaggtacagcagaagccaatgtccttgttgaactgtgtgagatatagcagtttgtaaactatgacatattcagttttttttttttctt

SEQ ID NO: 14898 - DNA, 312 bp, Homo sapiens
gattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtctccaagaaattaaactggcaagtggaaatgtttaaacagttcagtgatctttagtgcattgtttatgtgtgggtttctctctcccctcccttggtcttaattcttacatgcaggaacactcagcagacacacgtatgcgaggggccagagaagccagacccaaa

SEQ ID NO: 14899 - DNA, 271 bp, Homo sapiens
tgcagtggctcacgcctataataccagtactttgggaggccaaggacggtggatcacttgaggtcaggagttcgagaccagcctggccaacatggcaaaaccccatttctactaaaatacaaaaaattagttgagcatggtggtgcgtgcctgtaatcccagctacttgggaggctgaggcaggagaatcacttgagcctaagagtttgaaaccagcctgggcaacatagggagatcctatctctacaaaaaaaaaaaaaaaaaaaaaaaa

SEQ ID NO: 14900 - DNA, 431 bp, Homo sapiens
aaagtgttagctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggcagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtattttc

SEQ ID NO: 14901 - DNA, 377 bp, Homo sapiens
gtaactctatcataacaaaaaatttgtctaaatatgcctataaatgtctaaaatgacatatcaagaaaaaagaataagcataatattatagagataactaccaaaagaaagggtgaaaaaaatcgtcttggtggtgggttagcggacagtttcagaatgtggagagatatgagacagataataacttctttaaaaaatttttcaatttttattttacattcagggggtcatgtggaggtttgttacatgggtatattgtgtgatgctgaggtttgggggataataacttgttcattatagactttaaaaaccacatctggatgtttcttttatacaacttttttagttaaaaaaattaaatgtaaataaaatagcga

SEQ ID NO: 14902 - DNA, 494 bp, Homo sapiens
agtatctgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggtcattgtgaatgaagtcttctaactctgtctcaagtttcactgtcgcattttccttttctaataaaaatgaccaaatcc

SEQ ID NO: 14903 - DNA, 628 bp, Homo sapiens
gcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggtggagatgaagcttcttcatggagtaaaaaatgtatttaaaagaaaattgagagaaaggactacagagccccgaattaataccaatagaagggcaatgcttttagattaaaatgaaggtgacttaaacagcttaaagtttaagtttaaaagttgtaggtgattaaaataatttgaaggcgatcttttaaaaagagattaaaccgaaggtgattaaaaagaccttgaaatccatgacgcagggagaattgcgtcatttaaagcctagtaacgcatttactaaacgcagacgaaaatggaaagattaattgggagtggtaaggatgaaaccattccggagaagatagaagttggagtgggaaactggaagacagaagt

SEQ ID NO: 14904 - DNA, 330 bp, Homo sapiens
ggatgaggcagacaagttcattgaaaaatacaagttcattgaaaaatacatataacaacccaattttaattctaaccctgtgccactaagtctgaatagctctgatctattagaaatttaaaaaaaatttttttaatttaaaatcttcctatgaagtaccaggcccaaatgattcactagtgagtcctttcaaatacttaaggaagaaatggaagaaatattctaattttacacaaaatctttagaaggtaaaggaggtgggagtacttaaaaggccagtacaattgaaatgccaaagtctaacagacgttacaagaaaaaattatagac

SEQ ID NO: 14905 - DNA, 394 bp, Homo sapiens
tttgacttgaaaacaagctccatcccttatctttatttataagaagagaagacctcgagcgaggcggcacgcgacccaggtgtgtgtgaattgaatggagacgtttctctactctttctttaatttttgtttttgtgctttttttctttaaggaaagttttatttcactgttcattttactttcttggtaacaaaaactaaaataaggaatagaaaagctgtttttcaggctgacagtccaattaagggtagccaagaccttgcatggtagagtaggaaccatagtgtcagagaggtcccgtgaggctttgtgaagcctggtgtcatcgccggcactgtttgcttatgcaagggcaaaaatctttgtatctggggaaaaaaactttttttcaaa

SEQ ID NO: 14906 - DNA, 156 bp, Homo sapiens
gattttgctttctttaattgtcacacaacagctttatatattttagtatctaaaaagcacaggcaatatcttagacttcacaggtcacttctgagagctggtggcaatttatcctaaacacaaactgattaaccaaaaaaaaaaaaaaaaaaaaaa

SEQ ID NO: 14907 - DNA, 433 bp, Homo sapiens
ggacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaatt

SEQ ID NO: 14908 - DNA, 567 bp, Homo sapiens
agttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccagctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacagga

SEQ ID NO: 14909 - DNA, 501 bp, Homo sapiens
aatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaaataggtggtagatattgaggccaagaatattgcaaaatacatgaagcttcatgcacttaaagaagtatttttagaataagaattgcatactacctagtgaaactttct

SEQ ID NO: 14910 - DNA, 469 bp, Homo sapiens
atttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgc

SEQ ID NO: 14911 - DNA, 445 bp, Homo sapiens
aagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaacca

SEQ ID NO: 14912 - DNA, 574 bp, Homo sapiens
tgtgaatacaggctgtatggacacttgcttccatcccattttcctgcttccttgggttgccaatcaagagtatcctcaaaacgacttgactttaattttctcggaggtgataggcttccacacaggtctccagaaaccccgcattgaatatccatccacactttggttttccttcagacattattatgtctgtactaggcaactaattcagactgtcctggttgggaatattctgtgatgctctgactcccctagtctgtagacggaattggcatacggtctaatttgtgtagtaagcacctttgttcatactagtagtgactgtattcttgattcagcctgatagctaccatgctgctgtcaaaaccaaccagaggggagcttgttcttctgctgtagtgtgcagtgactggcctcacccaggactttgatgtgagaatgagcactttcctctatcaggaaatttcaagtgtttcctgttattcgtagctcaatgtaatgcctcagttcatttcagttgtttgatatatgtgactaatatgtatttttatcaaacaagacttctgtacatgtt

SEQ ID NO: 14913 - DNA, 482 bp, Homo sapiens
ctgcaggaaatcgacggggacaggctcgccgacttgcccctaattttcgatgggccatacccaataggcagatcaatgatgggatgggtggagatggtgatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaa

SEQ ID NO: 14914 - DNA, 186 bp, Homo sapiens
ataccattaatgaactagcagaaaaagaaatcaagaaagcctcaaatttataatagctagaaaaaagtaaaattcctaggaataaatttaaccaaggagatgaaagacctacaacaaaaaaccgcaaaacactgatgaaaaaaattaaagagaacacacaaaaaaaaaaaaaaaaaaaaaaaaaaa

SEQ ID NO: 14915 - DNA, 336 bp, Homo sapiens
cagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagtaagtatccaaccaacttggttctgcttcaataaatctttgggaaaactaaaaaaaaaaaaaaaaaaaaaaaaaaaaa

SEQ ID NO: 14916 - DNA, 509 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattcaaattctgcttgcttgcttttaatattgatatgcttatacacttacactttatgcacaaaatgtaggggt

SEQ ID NO: 14917 - DNA, 567 bp, Homo sapiens
caacttcttagagggacaagtggcgttcagccacccgagattgagcaatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatcgaaaatataatgcttctaagaaggaacagtagtggaatgaatgtctaaaagatctttatgtgtttatggtctgcagaaggatttttgtgatgaaaggggattttttgaaaaatctagagaagtagcatatggaaaattataatgtgtctttttacaatgacttcagctctgtttttagctagaaactctaaaaacaaaaataataataaagaaaaataaataaaaaggagaggcaaaaaaaaaaaaaaaaaaaaaaaaaaaaaaaa

SEQ ID NO: 14918 - DNA, 495 bp, Homo sapiens
  misc_feature 453: n = A,T,C or G
tctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactcnaaaagacactaaattgtactaattgtacaaaggtcaagccaa

SEQ ID NO: 14919 - DNA, 336 bp, Homo sapiens
catagcctcgagaggtaaaacttatcctatttttaatttccagtggtagcactttgtaaataaaaattatggtgtatgtgccaaaagcctggacttttgtctggcaaaggttgtttaaaacttgaagagacatcaagaaatatgtgagttcatccacccagatctagccagaactacttttgaatggttctgtggctcatttaggcaattaaagccttgtgattgccctattaaaagtctgaaagtatgcatataacccaccagtgttttacagaggaataataggtaagatttataaaacatctgaaatgaaaaaaaaaaaaaaaaaaaaaaaaa

SEQ ID NO: 14920 - DNA, 371 bp, Homo sapiens
ttgcctacgcttggtctccacgtcctccctttccccgtccaaggccgtcactggcttgggctgctccgttggtccttgcagccgtgccgagcgcacatctcctgatagctcctactctgggcaaggagctgactcggcagtggacaaattgaggcaaccaaataataaacacaaatggatagtcaacacattttttgaaagaacatctgaaagacaaaatggggaatggcgagtctgtctaataaaccattttgagaaaactggatattcatataaagaagtataaagaggactgttatgttgcacaatacacaaaaatcaactcaaaataaattaatgacctaaacttaatatcagaaatgatgaaacct

SEQ ID NO: 14921 - DNA, 579 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattat

SEQ ID NO: 14922 - DNA, 410 bp, Homo sapiens
taaaattcataaagtaaaaggaaaataatgaaataagttggtaaagtaggaaaccgtggaagatcatagatgtgacatagaatagtgtagattctcagaacttctctgaaaaaattgtaacagtgaggataattaagtgaagtacatatatgcttaaaagtttacatagcaatatatgggagatgaatcatacagtagacttttacattttaataaagatagtgagatactgtaggataaaacttcagaggaatatgcaacagtggaagttgacaccttgcttgaagagctacatcaaatgacagtgcgatcagtagtgatatatattatgaaggtaaaacatttatgtaccaatcctatacatgagggagggttggtcatagagaagctaattaattcattcctgactg

SEQ ID NO: 14923 - DNA, 464 bp, Homo sapiens
  misc_feature 406: n = A,T,C or G
agaaagtttccttaaagttgtgagcatgtttggtaagggctcaaatctcttgatagttcctgaaggtgccacgcattatcatttgacagagctttttattcccattgaagcacatgacttagagggagttacttgagaagtattaggaatttgggtaaaatttaaaggagtgactgtcttatgactagtgaagaatgtttcacagtggataatgttttagaacttatttagggaacatggaacttgaagattaacacatgtatgagaagaaacacatgaatcaggatgctatgattaatgctctaatttagcaggacctaacattccactgcatttagggctcacagctacatttttcaaggattttataaatgcagctttggatttattacatacttcccaaagntattctgcctctgcataagttgtatgttggaaattctgcactgcctactttttttttt

SEQ ID NO: 14924 - DNA, 580 bp, Homo sapiens
gcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggggcttaaacagcttaaagtttaagtttaaaagttgtaggtgattaaaataatttgaaggcgatcttttaaaaagagattaaacccgaaggtgattaaaagaccttgaaatccatgacgcagggagaattgcgtcatttaaagcctaggtaacgcctttactaacgcagacgaaaatggaaagattaattgggagtggtaggatgaaacaattcggag

SEQ ID NO: 14925 - DNA, 387 bp, Homo sapiens
aagcaggcagagattatgccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgcccacctgctgctcataataaatgcagatgtattgc

SEQ ID NO: 14926 - DNA, 420 bp, Homo sapiens
ttgagaaactagaatatcaccataggaatattattttgagaatgaatttaaagagatttaatttgctctatccagtgcagctggagacaactaaagtacgactgccaacaaatcctgcctcaaaccaactctctttatgactcattgctccatgttgagaaactcacatcagcccttgatgactcagttcagtcaattataaaccaggaaagataatatttattgtctttcagggtgttgcaagaatgcattaatgtttatagcacattcgtaaaaggtccaaaaacaggatttcatattatatttctagtattcccacatgaatttgaggtgctcttttaaaatctgaacatctatcacaagaactggtataatactttaatataaaaaaattactaataataaataacaattttagtc

SEQ ID NO: 14927 - DNA, 550 bp, Homo sapiens
cagtatctattgcataacatgaaaatcgcatttttacaaaatgtattgttctgaatgtatagcttaccatataattaaatataaaagtgttttttttaattgcttaaaggagcaaaaggatttgtcacattaaaagtatggagttttctgatgaggaaaataggcgattttgagccattataattgctttttaaattgtatttctaaaatataaccgctttttaaagttttcacttctaaaagacattttgcaagacactaaaggtcactcattgtaaaaactaaaagggctgctctcaaatctacatgtgaatgtcatgcttcatatcaatgcaatattcagcatctaactttcagaaaggcagagagaatgctgtatcattatgtattgagaatagcccaatatctgctagttatctatctttctttcctcatattggtgctacacctttcaacagataagaacactgaaatcagaaaaacactctgtaacttagaattagagccccaaataattttattaacaaacccacagatatataatatttcg

SEQ ID NO: 14928 - DNA, 367 bp, Homo sapiens
gagcatttgaataatagggacttatatagttcacctttccaggaaaattgaaaaatgatgccttcagaataatattgattagatacaaatttggttaattttctaaaaagttataaaacggtaacctttgggtttctgctttctctaggacggaaatgtacaagttacatggaacttcacagtgtctagactctaatcagatagagtaagtaggcaggttaacagttttctagtatgccattggaaggataaattttcttaatgttagtgtactgtggtagatactgtcaaccaagttaaaagatacaaaggttgattaccttgatcaaaaacaccttagaacttaatagtaaaactaaacaacaac

SEQ ID NO: 14929 - DNA, 68 bp, Homo sapiens
acaattccaagttctcgcttcctcctttgggcatcactgcaagattccatctcaaaaaaaaaaaaaaa

SEQ ID NO: 14930 - DNA, 656 bp, Homo sapiens
ctaacaggcctcttttaaaagctcagcatgtttaatgtaggtgttgctaacgtccaggtggctcctataagttaagggtccattgatttagaagttctaaaagagactaacctaagggataccaataacagatatttttaaagaatttcatagaggagatacacattagaaacccagaactctaagatgtgcatttgctaagtcctgtaaacagacaggaaaacacatttacattagtttgccctttaaagattatttcctacttgtctcttatcaatgtgagtacataaaagagaccttattacaattaaaaacaatgatggtttagcagcagatttagataccttacattctctctttaagagagagaatgtaaggcctggtgcggtggctcacacctgtaatccagcactttggcaggccgaggagggtagatcacctgaggtcaggagttcgagaccagcctggccaacatggtgaaaccccgtctctactcagaatacaaaaattagccgggcgtggtggcgcatgcctgtaatcccagcaacttgggaggctgaggtaggagaactgcttgaacccaggaggcagaggttgcagtgagccgagatggtgccattgcactcagcccagcaacagagcaaaactcctatctc

SEQ ID NO: 14931 - DNA, 180 bp, Homo sapiens
gggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccaaaaaaaaaaaaaaaaaaaaaaaaaaa

SEQ ID NO: 14932 - DNA, 489 bp, Homo sapiens
tattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgggatacttgaaaa

SEQ ID NO: 14933 - DNA, 479 bp, Homo sapiens
atatctggtggtaattgttaatgtttcagcagggctggtctcagtcctttaaaatggaaagctttatttggagcccaaccctataagatgaagaaatcctatatagtcttattcaccaatatatccaatacacccacagcaatggtacctttttaagatcaggattttattatgaattcctgtcactttctgttttccatttaaatttctattttacaaatttttcagggaatcatattcttaacttcactgagaaaaatgtgttactcttttggacaatttatcttatttctatcatataagatgtattttttattgtccttaaaagaagctctagcatgaaattaaaggaaagggaaagaaatagatctggtgcacccgaacattaggagaaaatgaaaaatatacaaccaaccgttcgtgagtcatcaaaaaagtcaaagtcagcctggccaacatggcaaaactccgtctctgca

SEQ ID NO: 14934 - DNA, 572 bp, Homo sapiens
aattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgctagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaaagttgac

SEQ ID NO: 14935 - DNA, 553 bp, Homo sapiens
ctgtcatttgtatgtgacttcatattgtatgaagaaatgaagatacctccatgtgtccatgtcttgttatatggacataagtcatattggattaagagctcaccttcctccagtaaaacttcatcttaactaattcaatttgttacaaccctatttccaaataaggtcacattctgagatcctgcgagttaggacttcaacataactttatgggggatacaattcaatccataacaggtggtcagggcctgaattaagtagagattatggcattaaggatgttgaaagctaatagctggcatgagaatctgaatgaagaatgaatggcatccctacaatgggggtttgggacataatcccaaaagacaccatcctgaataccgtaaaccctattgtgaagatcctgaaagattgaaatcctgaaagtgtaaaatccccaaaattacaatctcaaagaatcaaaattccaaaaatataattatttttaaaaggagagttgagaaacatataaaaatgtgatagaatacaggcagtaatgacatacatatttttg

SEQ ID NO: 14936 - DNA, 345 bp, Homo sapiens
gatcacacctgtgaatagccaccgcactccaacctgggcaacacaacaaaacctcgtttctaaaaaaaacaaaggctgagcacggtggcttacacctgaaatgccagcactttgggaggctgaggcgggcaaatcacttgaggtcagaagttcaagaccagcctggccaacatggtgaaaccctatctctaccaacataaacattagccgggcgtgcctgtgattccagctgcttgtggggctgaagcacaagaatcgcttgagccccgaaggcagtggttgcagtgagctgagattgcggcactgcgatccagcctgggcaacagagtgagactccatctccaa

SEQ ID NO: 14937 - DNA, 425 bp, Homo sapiens
gggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctaaa

SEQ ID NO: 14938 - DNA, 523 bp, Homo sapiens
gaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaagggctacagagccccgaattaataccaatagaagggcaatgcttttagataaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtgg

SEQ ID NO: 14939 - DNA, 568 bp, Homo sapiens
gctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcct

SEQ ID NO: 14940 - DNA, 556 bp, Homo sapiens
gatctgctttaacaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcacaacaagatcacaaagctgggctcttttgaaggattggtaaacctgaccttcatc

SEQ ID NO: 14941 - DNA, 330 bp, Homo sapiens
ggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccgtatggaagttccttttatgcattggaggaaaaacatgttggcttttctcttgacgtgggagaaattgaaaagaaggggaaggggaagataagaaggggaagaagataaaaaaaaaaaaaaaaaaaaaa

SEQ ID NO: 14942 - DNA, 369 bp, Homo sapiens
atgttttgacatgatatgaccaacattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaagaaattgtattgacaacacttagtatgcagttgataagaggaatttggtataattatggtgggtgattattttttatactgtatgtgccaaagctttactactgtggaaagacaactgttttaataaaagattacattcca

SEQ ID NO: 14943 - DNA, 476 bp, Homo sapiens
gagttggatgtttgttacaaagagcaaagccagacgattcttggaagatgaagcagtctaagcaagcaagaagataagagaaaggttatatcatgttctggttgctaaaaggagggagtggttagagatcagccacaaaggaggacagtgccctgataggaagttttgttctctgtgttaaggttcttggattttgtgctaagactaaagataaaccattcaaaaccagttttaagtatgatctgtaaactttgatctgaatcagaatcatctggtagagatattaaaaatacagctttggctgggtgtgatggctcccactggtgatcacagcatgttgggagatcaaggcaggaggattgcttgatgccaggagttcaagaccagcttgggtaacatggtgggacaccatctctacaaagtaaaaataaaaataaagtaaaaattagccagactttggactgcaggaagactaa

SEQ ID NO: 14944 - DNA, 314 bp, Homo sapiens
ccacttttcggctatcataaatatgcctgtattaatatttatatgcaagtttttgggtagacatatgttttcatttctctttgatttctgagttaaatgataactcgatgtttaacttttaaggaactgacagactctcttccaaagtggctgtacccatttataaatattttttgaatgaaagaattctgtcatgctgaaaatgctttttattcaacaaatactcatttagaatatgtggaaaaaggcaaatagcaaaggaattaaaaatttaaaatagaatacaaaaaaaaaaaaaaaaaaaaaaaaaaaaa

SEQ ID NO: 14945 - DNA, 534 bp, Homo sapiens
tcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcggtgtggactcctagaacgtgcgacctgcctcaagaaaatgcagttttcaaaaacagactcagcattcagcctccaatgaataagacatcttccaagcatataaacaattgctttgggttccttttgaaaaagcatctacttgcttcagttgggaaggtgcccattccactctgcctttgtcacagagcagggtgctattgtgaggccatctctgagcagtggactcaaaagcattttcaggcatgtcagaga

SEQ ID NO: 14946 - DNA, 293 bp, Homo sapiens
cagaaacgttataaatacatggaaattaaacaacatgcccctaaataaccattgggttaataaagaaataaaaagggaaatttaaaaaatttcttgagatgaatgagaatggaaatacatcataccaaaacctgtggagcacagcaaaagcagttctaaaagggaagtttatagtaataaatgcccgtatcaaagaagaaagatttctaataaaaaacctagtgatacacctcagggaactagagaaacaataacaaactaaacccaaaaaaaaaaaaaaaaaaaaaaaaaaa

SEQ ID NO: 14947 - DNA, 326 bp, Homo sapiens
tgtaggagatactggtgacctaagctaagttgttctcagcatactcagggtcaagctaacgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtgaaaaaaaaaaaaaaa

SEQ ID NO: 14948 - DNA, 513 bp, Homo sapiens
atgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagatccccgagagtaaatcatctttccaatccagaggaacaagcatgtctctctgccaagatccatctaaactggagtgatgttagcagacccagcttagagttcttctttccttcttaagccctttgctctggaggaagttctccagcttcagctcaactcacagcttctcaagcatcaccct

SEQ ID NO: 14949 - DNA, 438 bp, Homo sapiens
catgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtagggaagtcacccaaacacttctgcttcacttaagtgtc

SEQ ID NO: 14950 - DNA, 456 bp, Homo sapiens
gacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaatttaacacc

SEQ ID NO: 14951 - DNA, 312 bp, Homo sapiens
gtgatgagggaagcagctcaaaagctgacacctaaacccagaataatttcagaggtgaaaaattaccacctctcttactagtgacattgaagagaaaaaaaattagggtttttcactgatatgttactagtatttaggcaaaaacacaacagaaaccaaatcaagtcactataaagcagtaagaaaatatttaaaaaagacattatcaaactttagtgaatgttattctaagtctcgaaaatttagatgtctgtttagactaaaattttgccaaaaacaaatccgaaaaaaaaaaaaaaaaaaaaaaaaaaa

SEQ ID NO: 14952 - DNA, 616 bp, Homo sapiens
gggttggggtgtcagacgttttctcgctctaaggagattcttcaagcaatcactatgtcaacacacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcatcaagggaagtcaagttaacttaaacatgtcacctaaatgcacttgatggtgttgaaatgtcaccctcctaaatttt

SEQ ID NO: 14953 - DNA, 538 bp, Homo sapiens
gatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatccaaa

SEQ ID NO: 14954 - DNA, 216 bp, Homo sapiens
caaactgccgagttcaagcgatctgccagccttgacctcccaaagtgctgggattacaggcatgagccacctcacccggccccatacatttcttttttaatgaggaaataataagcttatttgtaccccagaatgattggacaatataactcattttctctataataaattttaaaaatgaaattcatcaaaaaaaaaaaaaaaaaaaaaaaaaaa

SEQ ID NO: 14955 - DNA, 507 bp, Homo sapiens
actccaagggccaccagaagcgcacggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgtccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataactttttttaagttacacatttttcagatataaaagactgaccagtattgtacagtttttactgcttgttggatttttgtcctgtgtttcctta

SEQ ID NO: 14956 - DNA, 387 bp, Homo sapiens
caatgctgattggtgcatgcatatgaaaaagcttcctgaacccagggaaagaattgtcagaggaaattagaccagtgattggtgctcatacaggacttcttcctatccagactggaaagcctcgtgcttcatgggacactgggtagagtactcagaagaatcttgtttcagtagtagggatatttagccctaaactaaatgtggtctggtcctacataaaatattttaaaggcaagattcaaaatgataaatggtttccaagtatttaatgtcattacagaacaaagcttaggaatattacagaaatacaaaaatactcatcactgaaaaaagttcacataatgtagcatttagtcaaagattatcaggtttgcaaaaaaaaaaaaa

SEQ ID NO: 14957 - DNA, 388 bp, Homo sapiens
gtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaa

SEQ ID NO: 14958 - DNA, 183 bp, Homo sapiens
ctttgccagtctcgttttcatcttcttccatggttccacagaagctttgttttttgggcaagcagaaaaattaaattgtacctattttgtatatgtgagatgtttaaataaattgtgaaaaaaatgaaataaagcatgtttggtttttcaaaagaaaaaaaaaaaaaaaaaaaaaaaaaaaaa

SEQ ID NO: 14959 - DNA, 544 bp, Homo sapiens
gaaacaaagagctgataatttgaaaagataaaattgatagactgttagattaacaaagtaatgaagacagaagatccaaataagctcaattagaaacaaaactggacatattacaactgataccacagaaatagaaaagatgattcaagtctactctaaacaccttcatgagcacaaaatagaaaatctagagatgcatacattcctcaaaacatacaaccctcctagattaaatgaggaagaaatagaaacactgaacagaccaataacaagcagcaagattgaatcagtaattttaaaaatgccaacaacagcaacaaaaaggccaggaccagatggattcacaggtgagttctatcagacattcaaggaacagttggtaccgatcctactgaaactattcgaaaagatagagaaagagagaatcttccccaaatcattctatgaggctaatattaccctaatagcaaaaccaggaaaggacataacatcacatcaaaaactacaggccaatatcactgataaatatagatgcaaaaaccct

SEQ ID NO: 14960 - DNA, 300 bp, Homo sapiens
agggtactattcattcactcttcctgcgtagaagatatggaagaacgaggtttatattttcatgtgggctactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggcaagagttaaacttagaagaccctttgtctctgagaagcatccttctaagacattc

SEQ ID NO: 14961 - DNA, 121 bp, Homo sapiens
aaaaatgcacaagttataaatacagaagaaagagcaacccaccaaacctaacaaggacccccgaacactttcatactaagactgcaagtagatcacagatctgcggatattgtgagtcgat

SEQ ID NO: 14962 - DNA, 553 bp, Homo sapiens
catctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaattggtataa

SEQ ID NO: 14963 - DNA, 296 bp, Homo sapiens
ggcccgcaatactgtaggaacaagcatgatcttgttactgtgatattttaaaaatccacagtacccactttttccaaatgatcctagtaattgcctagaaatatctttctcgtacctgttacttatcaatttttcccagtatttttacacggaaaaaattgtattgaaaacacttagtatgcagttgataagaggaatttggtataattatggtgggtgattattttttatactgtatgtgccaaagctttactactgtggaaagacaactgttttaacaaaagatttacattcca

SEQ ID NO: 14964 - DNA, 532 bp, Homo sapiens
agaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggaccctacttcagaggaagttgctctctgggagaagatggtgaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaagggccaagggattaaatataacaaaatgtgtatttgtgactctaatattaaat

SEQ ID NO: 14965 - DNA, 674 bp, Homo sapiens
gtcacctccaaatgctgctggtcagcttcccacatctccaggtcatatgcacacccaggtaccaccttatccacagccacagcgtaagtagtgtgaccccaaagtcctttcagagcagtatttatgatctaatttagtaactttactttgaagccccaaagtcattgtcaaatcaataagtaagaaccattgtgcataggattcctgagtccctgctacaaagagacatgtttttttaggaggtggcctgaatcactatgctaggaagtagctcctttgtcacactgttcagagtagttgactcctgttcctcagccattactaagacttgttaaagataatcaagtgtcccgtgattttggtataaagaaacagaattttagaaattattttttacatattctttttcttcaggcaagatgacacaaattatttttggaaaaatggtttcaaggggcatttgttattactgtttttccactttatttacttatttaatagactttgtattttagagcagtcttaggttcagaacaaaattgagcagaaagtacagagtgcccccactatttacatccctacgccacagtggtgtatttgttacaatcgatgaacctacatcaatgtctcatatcaccaaaagtcacagttacactctcagtgttgtacattcc

SEQ ID NO: 14966 - DNA, 557 bp, Homo sapiens
ggcttttaaaaagtaacgaaagcagtgtcaagacagtaaggattcaaaccatttgccaaaaatgagtctaagtgcatttactctcttcctggcattgattggtggtaccagtggccagtactatgattatgattttcccctatcaatttatgggcactcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctctttgaaggattggtaaacctgacctcatccatctc

SEQ ID NO: 14967 - DNA, 535 bp, Homo sapiens
gggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctccgggtttttgtatatttaatgatggatcaata

SEQ ID NO: 14968 - DNA, 597 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaccgtaattttaatagcttaagattttaagagaaaatatgaagacttagaagagtagcatgaggaaggaaaagataaagggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgggaagattaattgggagtggtaggatgaaacaattggag

SEQ ID NO: 14969 - DNA, 327 bp, Homo sapiens
atttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccacccaaaaaaaaaaaaaaaaaaaaaa

SEQ ID NO: 14970 - DNA, 484 bp, Homo sapiens
aactaagttttgtggtacttcaccctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggctcccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgagatcaaataaccaatataaagcatatttcttggccttgctccacaggacataggcaagccttgatcatagttcatacatataaatggtggtgaaataaagaataaacacaatactttactgaaaa

SEQ ID NO: 14971 - DNA, 242 bp, Homo sapiens
atcaagtaggatgctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttttttttc

SEQ ID NO: 14972 - DNA, 470 bp, Homo sapiens
attcaagacggaaggtacaagataaaagacaaagaggtatacacatcaattaataaaatatttttgaggaatttaaatattaactataaaaattaagattagataatgcaaggtgtaggagtgtgtgtgcgtgtgtgtgtgtggtcaagaacatggactctagagctggattgtctaggtttaaattcagactaactgcttaactacctgtatgaccttgtgaaatacattacttattcattttatatcagtttttctactctgtaaaatgggggcaaaattaatacttatctcactggcttgttgtgaggattaaatgagttaatatgtttgtcatcatcatcaccatcattatcccaacatttttgtagaacatattaaaaagtccttaaagcccttgtatattaatatcacatattaggggctagagttggtatggaaatgggaggagaaaattgtttattttaaat

SEQ ID NO: 14973 - DNA, 253 bp, Homo sapiens
cttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctctaaaaaaaaaaaaaaaaaaaaaaaaaaaaaaa

SEQ ID NO: 14974 - DNA, 295 bp, Homo sapiens
ttgtccaatatgttctcaccatcgccacgtttggctgtggacctcttggggcaaggtctgtgtctgtttttctcactgtattaccagttcctatctcgttaactagaatagtctttcattaagtgggtaagtgaatctacccctgaaataatgctaagcgtggggttctgggagagtatatcatcaataaaggattatgttctggccttgggccttaagccactcacttaagatcctctgagccctgattccttatctgaaaaaatgtgtatagtacctattttgccaatacata

SEQ ID NO: 14975 - DNA, 548 bp, Homo sapiens
ccaaatggaaagaaaattggtcaggtccgagagaccaaattgtacagcacaacaaaagggttattatttgtgaaaaatttaggtgctccccccatgtgacttagaaagtttgaagttttctcttaaagtaatcattcgtctttataaagtttagaaggtacacaagctttattactatgaaaggctatgcttattttaattcacagcgaggcacaaagtgattgcctagtacaaaaccttttaaaataataatgaaaaacgccaagatgtcaaatcaaatggaaatgtggaccctaatttgattgcctaacttcgaaacatgtttcagaactgcacctacccacgtattatgcttgcgataagttatatgccaaagctttgtgctgataatattttaatgtgcaatatttagcgtactgtaagaattaaacatttatttcccattaaacgatgtattatatttcttttaactttcggtcaaatgtgtgacctgtagcccaccccctttcctcattcttttaaaagaaattaaatcccagacctttttt

SEQ ID NO: 14976 - DNA, 435 bp, Homo sapiens
aagggctttctagaactacgaatgatatttctgaattttttaaattcagtcgacaaattgtaaaaatgaatgctcactgctgagaatagagttcgtgttctggaagatcgagttaaatacctcaagacacagaactagccctcaaaagtagaaatcgtggaaaaataaaagagacttggagaacaaattcagaggatctaccatattaaccatgggaatgcagaagatatgaagtaccaggtggaaggaaagtggtaagccaaaagcagaaggaaaaattgaatgtaggacccaagctaaagaaatatttggtcctttagattaaaaggccactgagccttagaggatgaattaagaggaaaaacaaacaaaccttagacatactttggggaaattcccacatctcaaagaggggaaaaaaaatcttacagaccc

SEQ ID NO: 14977 - DNA, 599 bp, Homo sapiens
ggggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagttaaagaattccagctggtaaaacatgacctggacatttgt

SEQ ID NO: 14978 - DNA, 500 bp, Homo sapiens
tggatcaaaagttccttcctatgtaaccaattagggctaaaggtgaaggtagctccattatcaagcagaggagagacttctgaggtcctttgtctgtcacttataacatttgcttgacaacaaaccccatgacacaagtttacctgtgtaacaaatctgcacatgtacccatgaacttaaaataaaagttaaacaaacaaataaaacccaaacatttgtttgggtgtgctagtaaggttcttgttattgattgtgcgggcaaacattatgcatgatgagttatacagcctgatattgggaggaagcatttggaaatagggtaaaatcacagcagatgggaaaggtgtttataagtagattacattaccgtggagggaagccactacaatattttcatgcaaacagctcagagtgaggatatcatacttaactaacttttgctattgtcatccaaacaaatgggctttgttggtgaaaatctcttggcctgcttactgccg

SEQ ID NO: 14979 - DNA, 621 bp, Homo sapiens
agttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagcttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacatactagttttagggatttcagatgggaagctgcatttttaggattgccatcttaagagatcctgcaggaagagatgtattagatatatatttattcattaagataattttcaaagttaa

SEQ ID NO: 14980 - DNA, 357 bp, Homo sapiens
gagcgttggtgagttcttcccaaaggaaaggaatttcttcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctagtgtaaataatagtaaattattgagaattctaattcttttacacagtctgtttttaatctattttaattaaataaaatctatgactccaaaaaaaaaaaaaaaaaaaaaaaaaaa

SEQ ID NO: 14981 - DNA, 429 bp, Homo sapiens
aaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgctcataatagtgtgtggcatgtatgtgcagactcttggatgctttatgcctgcgcaacaagagccctgt

SEQ ID NO: 14982 - DNA, 226 bp, Homo sapiens
ttagagcaaaagacttctgtattattttccgaaatacaggttgggtatctcttgtctgaaatgctcaggaccagcagtgtcctctgagggtgggacctgggaaccctacatgtttaattcttgtgtctgctaacatttgatttagaggctggtgcaaacatttctacacttgatgatacaaataattaatttttgtatgaaattttagagcacaaaaaaaaaaaaa

SEQ ID NO: 14983 - DNA, 513 bp, Homo sapiens
acatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgcatttggtgtcacagcactacagtgaaatacacaaaaaatgaaattcatataatgacttaaatgtattatatggtagaattgacaacataaactacttttgctttgaaatgatgtatgcttcagtaaaatcatattcaaatttattc

SEQ ID NO: 14984 - DNA, 174 bp, Homo sapiens
acctggaggtctggacagttttactgtaacctcttaagttttaatgagctaaatatatctggtatgattttttattttaaaataacatgggaaatatatccaagagattatgattctgtaaagctgtggaatgaagctgcagatttagagaacatgggcttctgaaaaaaaaaa

SEQ ID NO: 14985 - DNA, 626 bp, Homo sapiens
gattcctgaagctgacagcattcgggccgagatgtctcgctccgtggccttagctgtgcttgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttcttataattctactttgagtgctgtctcatgtttgatgtatctgagcaggtgctcacaggtagctctaggagggctggcaacttaga

SEQ ID NO: 14986 - DNA, 401 bp, Homo sapiens
aattgagacttatttgaagacattcaatattctatcttcatttctcaagtgcatgtgaccctaagagccatttttaacatttataaactattaattaagtaattaatttaaaatagctacagccagattcgatggctgacatctgcaatctcagcactttgggaggctgaggctggcagatcacttcagccaagaagttcgagaccagcctgggaaatgtggtgaaaccccacatccagtaaaaatataaaaatgagccgggtgtagtagcatgcacctgtagtcccagctactcgggaggctgaggtggcaggattgttggaacctgggaagtcaaggctgtagtgaactgtaatcacaccactgcactccagcctggatgacagagcgagatcctgttt

SEQ ID NO: 14987 - DNA, 261 bp, Homo sapiens
ataatcatgttggttttaatagtgtcaatttttgtaaaataaaaattaaacttcaaactctttactttataaattgtccataggccacactttaatatcacattataaagggaaggacagtcttcatttctcctggttattggtttgtttgtcattaaagatatattttgaatccatgaaattgctatgctaaacagcctttacatgtatggtctggttaaagttcctttgttccttttgttttaacaaaatgtgtcacaa

SEQ ID NO: 14988 - DNA, 620 bp, Homo sapiens
ggtagcttgagcgcggcggcggcgttgttcagtcagagcgagaacattccagagagctgttgcgcagccattggtacctgtattggggaaacatagcatacaagcaagaagcttacagcctcagtggtgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggta

SEQ ID NO: 14989 - DNA, 544 bp, Homo sapiens
atttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaggctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtacacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttg

SEQ ID NO: 14990 - DNA, 437 bp, Homo sapiens
gaggcagtgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtgtttaaaagaaaattgagagaaaggactacagagccccgaattaataccaatagaagggcaatgcttttagattaaaatgaaggtgacttaaacagcttaaagtttagtttaaaagttgtaggtgattaaaataatttgg

SEQ ID NO: 14991 - DNA, 493 bp, Homo sapiens
actgtgggttcaggtatatttatagtatagtgctctgattcttgatcatctcacacctattttgaagtattagcatgaaccacatacaagaaagtcaatagccaaaccttttccattcttcctacagctcttgaaactggcagccttgagaaccacccatttcccttactacctctcacctaagcctttcctggtgcacgatgttaactttacactatgtatattactatttaatgtcgacaccgctgtcttttcatttcacatctgttatgacattgtggctttcgccctttgcggtcagggaccataactctttgacatactgtgttaacagggacttactcaggaacagccatttggctgttcatggggtgtattcactgcagttttgaagctgagaaaagatagcttgaatccttttgtaagttctttggaaaatggacagattcctttttactgataacctatatcaacaccaaagtggactgtctta

SEQ ID NO: 14992 - DNA, 260 bp, Homo sapiens
aatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacccaaaaaaaaaaaaaaaaaaaaaaaa

SEQ ID NO: 14993 - DNA, 160 bp, Homo sapiens
gagacagcaagcaaagccagcaggacatgaagttgctattaaatggacttcgtgatttttgttttgcactaaagtttctgtgatttaacaataaaattctgttagccagaaaaaaaaaaaaaaaaaaaaaaaaaaaaaaaaaaaaaaaaaaaaaaaaaaa

SEQ ID NO: 14994 - DNA, 475 bp, Homo sapiens
caagtctcaaatgcctaaaaaaggccaaacttcctttggtctttggatatcattctggagggtgggtgagtctacttttgtttcaaatgtgttattttcatttatttttgagcaaaaatatcattttataatttacacttattgaacataaatgtggaaatactactaaattgtctccacatggaaaatttcttgtgacatgtatttcatctaacttgtgaagttcacaactatttcaaaaaacagttaagcttgttccaaaaactcactgccatcccaccaaacacacatatggacttgagaataattaggctttcaaaaaccactttagtatccaattaattgtagttttcttcagaaagtggtgtaaatctgattatagttgcttcatgtagtataaatctgattatacacagttgcttcatatagtatatatctgatgatatcaattgcttcatgtagttcaacttggtac

SEQ ID NO: 14995 - DNA, 623 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctcatgtttgatgtatctgagcagggtgctcacaggtagctctaggagggctggcaac

SEQ ID NO: 14996 - DNA, 531 bp, Homo sapiens
gaagagatgaagtagggattcatggagatgtataggggaggagtatccaagacagaggagggcaagtgcaaaggtcttaaggttagaatgcacctgccatgtttgcagagtggcacagaggccagtatggttgaaacagagccagtgagggagagaagtagaggttagttggttagaaaggtcagaaaggtcacttataggctgtgataaggactttggcttttactttcaagaaaccagtagagggtttgaagccaaagaattatgtgatttgacttacttttaaaaggaacattctgactatgttggggggagactagtctatgtgggagcagggaagattagaagcagggggtctagttatgaggctacctgtggtggcccagaggacagctggtagtggctcagattagcacagtagcagtagaagtgtcaggagcctaggcatatttttaagaaccaacacgatttactgatgcatcatatgtgggacacacaagtgtgaagagcaaatgggatgatggaggtggc

SEQ ID NO: 14997 - DNA, 412 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaa

SEQ ID NO: 14998 - DNA, 603 bp, Homo sapiens
atagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtcttatcgctaagaccttgactttaaattttcatcactacaaccttgaatttaatttcaggtctcaacatgatgaccttggatttaatttaaagtctcaacactatgcgctttatcatatattcacagagcattttgaaatgt

SEQ ID NO: 14999 - DNA, 567 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgggaagatta

SEQ ID NO: 15000 - DNA, 343 bp, Homo sapiens
ctctgcggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcca

SEQ ID NO: 15001 - DNA, 567 bp, Homo sapiens
ttaaaaataaaagaaaacagactcaagacagttttttcttatgcttgcttcagaatggtttaatgggaaaagcatggtttttatggcttgacctcatttctagctttgtcacttattagctgtattcttgggcattagtttcccaaaaggttttgaaaagtgagtgggaaacttagaagaaatcatccccaaaacagcactcagaacaaaataaatataacttaatttttaatcttccttttctctggaaaatactaatgataatttagaagtagtcagtgagacattgtatgtatgtgagcctacataagtaggaagcttttatattcaccactcaataacacagtgactgttgtctgttaaatgttgatgtggactcaccatacaaacaggtaactccctggttttgatagattaaaaaataaactcttcagccaggtgcaatggctcacacctgtaagcctagcagtttgggaggtcaaggcaggcagatcgctggagtccaggttcaagaccagtctgggcaacatgacaaaaccccgtatctacaaaaaatacaaaaaaatt

SEQ ID NO: 15002 - DNA, 332 bp, Homo sapiens
gataatgcttcagactgaaagggcactagacagttagtcaaatccatgtggaacagtgtgatgtattttttatttgtaactcctttcattccctatctaattcaaaagacaactgcatgtagcaataaatataaatctatgttaataggcacacgctatataaaaatgtaggttgtgacaaaaacaccataactggggtgggtaacaaaactataagggagcaaagtttgtatctagtatgaaaactaagctggtattaatccagaccagattgttatacattaagatgctaatagttttccctaagaaaataactcaaaaatatattataa

SEQ ID NO: 15003 - DNA, 495 bp, Homo sapiens
aagctgaacccagcttgcttttttacatggactcgcatcaatcatgctgattttgcaacagttcagctgacaaatggattgccctacttcagctatgacttggggagtggggacacccacaccatgatccccatcaaaatcaatgatggccagtggcacaagattaagataacgagaagtaagcaagatggaattctttatgtagatggggcttccaacagaaccatcagtcccaaaaaagccgacatcctggatgtcgtgggaatgctgtatgttggtgggttacccatcaactacactacccggagaattggtccagtgacctatagcattgatggctgcgtcaggaatctccacatggcagaggcccctgccgatctggaacaactcacctccagcttccatgttgggacatgttttgcaaatgctcagaggggaacatattttgacgggaccggttttgcaaagcagttggtggattcaaagtgggattgg

SEQ ID NO: 15004 - DNA, 420 bp, Homo sapiens
ctgtcagatggaagcctcaaacttttgcactttaggtcatctagtgtcttccagtgtttgcagttgtcagccaaatgttgcatcagggctggcagatgtgcaaaggctgcaaagacagaaaagaatcaaaagaaaccggtgaacttagaccccaggagcatttataagcctgggggtgtctgggacaagtttgggatcagaattagaggaggcacaccctgggcgaagcatgaggacaagtcattaaacactagtttctgaaatgcaaacaggtcctttttgaaaagctgcttatcagtgacattatcagaagaacctgtgattctaagtaaactaaatacattttgcattctttctagagtttcctccaacgacagaaaaacactgcagtaagctttggcagcgtgtcctttgaagagg

SEQ ID NO: 15005 - DNA, 677 bp, Homo sapiens
ggtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttgggagtggaggcattgtttttaagaaaaacatgtcatgtaggttgtctaaaaataaaatgcatttaaactcatttgagagaatgccttttagtttaatgcatatttaaactaaattgatcctgtagtgttcctgggagaagctagagcctgattgtaggctactactcatcaattaacttctacagtggagactacttctgggactggatataaaaaagaatcaaaggtctgattttgagttgcgataagggaaagacatgctcatagcagtgcaacatctgaagtgt

SEQ ID NO: 15006 - DNA, 224 bp, Homo sapiens
agaaaaataaaactcaattttgagaagtttgaacttgatactctttagcaaagctattatgtttgaaataattgaactggaatattttaacccaataaggatgtattttgcttaagctactggaactattccttaaagttgctcctctgaacaaggagtaagatttatatatatgaaatttgtgactaaagattttgatttgttattggaccttatattattgc

SEQ ID NO: 15007 - DNA, 387 bp, Homo sapiens
atggaatattctccaggatagatcatatgttagaaaacaaaacaagcctcagtaaaattaagaaagatagaaattatatcaaatatattttcagtttgaaactagaaatcaatcaggaggaatttcagaaaattcataaatatccagaaattaaacaacgtgctcctgaacaaccagttggtcagtgaacaaattaaaagaaaaattaaaatatttgcaacaatcgaaaatggaaacacagcataccaaacctatgaaatacagcaaaagcagctctaagagaaaagtctttaggaatacatggacccatcgaaaaagaagatctcaaataaataacgtaatgttacacctcaaggaactggaaaaagaacaaaccaaacgttcatt

SEQ ID NO: 15008 - DNA, 750 bp, Homo sapiens
  misc_feature 1, 5, 10, 12, 14, 19, 22, 23, 24, 32, 39, 40, 41, 47, 49,75, 84, 90, 102, 111, 136, 139, 150, 151, 153, 155, 170,172, 192, 197, 203, 210, 215, 227, 228, 235, 239, 244, 246,248, 259, 261, 262, 264, 265, 266, 271, 273, 276, 284, 297: n = A,T,C or G
  misc_feature 308, 328, 351, 362, 371, 383, 385, 389, 393, 401, 418, 427,433, 436, 437, 439, 440, 444, 445, 446, 448, 456, 458, 459,460, 470, 478, 480, 484, 495, 502, 504, 513, 515, 517, 523,545, 546, 558, 561, 575, 582, 586, 599, 607, 608, 610: n = A,T,C or G
  misc_feature 611, 612, 613, 616, 620, 621, 622, 623, 624, 628, 630, 633,639, 640, 641, 644, 646, 652, 654, 657, 659, 661, 663, 664,665, 666, 669, 673, 675, 676, 678, 683, 692, 694, 702, 704,707, 713, 714, 715, 718, 724, 725, 726, 727, 729, 731: n = A,T,C or G
  misc_feature 733, 735, 737, 744: n = A,T,C or G
nggancagancnangaacnagnnnccggccanacaatannnaggccncncgaaggcccttagcatacaaatactnatccaatangaaggnttcttaacaaanctgaggaanaagggaaaagagggggcctgacacnggntaaaggggggnnanancaacccatgaagccngnggaaaggcaagaaaccccangaaangcccgnaaggaancaacncgcccggaacanncagcagncagngaacnangnaaaagaaaaantnnannngaggnancgnccgaaaanggaaacaccgcanaccaaacctangaaagacagcaaaagcagcnccaagagaaaaggccccaggaanacatggacccncggaaaagnagacccaaacananacgnaaanggtacccncaaaggaaccggaaaangaccaaccnaacggnccnnannccgnnnanagggaaanannnaaaaaagccntaccaacntnggtnaaaagaaaccngaaaggngnaagggggananantcaaanggggggaaaaagaaggaaaacnnggccaagggggnccncggggggggggggnacccccncagnagggggggccccnggagaganngnnnnaanaaannnnngagngnggnggggannnggngngggggncngangngngnnnngangaangnngngaggnccgcccccngngggggggngnagnggggannngcnaccggnnnngngngngngnggggggnaaagcg

SEQ ID NO: 15009 - DNA, 666 bp, Homo sapiens
aagaactagtctaaccaagattaaatcttctaggttgaaaagagggggttgggggctgtcaataagtaggactctctttgaagggctggaggagtaaaaaaaattgcaaactctcccattttatattttttctttatatattcatatttatagctctcatatacagtggaatgaaatgctttcttaatccaaggtaaactaaacctagattctttaagcaaaccatttatttaattttggttttgcattaataaactcagtgtaactagggattatactttatttacagctcccattgccataaattgatgtccaaaagctttggatcatgttttcattaaaatcaaaatctgatgttctaggaatgggagttgttaagatgtggctttgcccccaacaacattttccaaataatctgttgcaaatgctgaaacagggaccagtgaggagggtctgtaagaactggacaatcaaatctgtgcttggataacaaactaatacaatgacatctactgtggctcctccagtcttaagctcttggtttcaagagaaggccatggatgttttcaaattggaaaaagccagaaggaagaaaaacacccctggtggcttgaccttaggtggtttctaggaaggggccttggtaagtcaaattttgctcaattt

SEQ ID NO: 15010 - DNA, 352 bp, Homo sapiens
gaatgtgaatggattcgacaatcaaataaaaacacagagttgcaggcccgctgcagtggctcatgcctgtaatcccagcactttgggaggccaaggcaggtggatcacctgaggtcagaagttcaaaaccagcctggccaacatggtgaaatggtgtctctactaaaaatacaaaattagctgggcgtggtggcgtgcacctgtaatcccagctactcgagagggtgagccaggagaatcacttgggcccaggaagcagagggtgcagtgagttgagattgcgtcattgcactctagcttgggcaaaaagggcgaaactccatctcaaaaaaaaaaaaaaaaaaaaaaaaaa

SEQ ID NO: 15011 - DNA, 519 bp, Homo sapiens
ggtggcagcattcaacagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaccctgacggctatgattactatgcctttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaacaaagaatattgacatggccc

SEQ ID NO: 15012 - DNA, 540 bp, Homo sapiens
gtggcaagtgaatttgcctgtaacaagccagattttttaaaatttatattgtaaatattgtgtgtgtgtgtgtgtgtgtatatatatatatgtacagttgtctaagttaatttaaagttgtttgtgcctttttatttttgtttttaatgctttgatatttcaatgttagcctcaatttctgaacaccataggtagaatgtaaagcttgtctgagcgtacaaagcatgaaatggatacttatatggaaattctgctcagatagaatgacagtccgtcaaaacagattgtttgcaaaggggaggcatcagtgtccttggcaggctgatttctaggtaggaaatgtggtaccctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtgtgcacctttctagttgaaaataaagtgtatattttttcac

SEQ ID NO: 15013 - DNA, 377 bp, Homo sapiens
actcataaatgatagtgtaacacaatgccctgtaagtggccaagggaaagtgggtgccactgtcagtcagtcatagagtaacttcctctcagtttcagaatacatcacattctattcatgacttgtgaccatttgaaagaaggatggaataagtaactggtgtcagtctgtaagatttgtataactaccacagagccaagatacaaatattaataaatcacaatttctcttttatttttgttgagaaatgagtataagtagaaatctaacattttcttcccacaccccagcagatactctggcacccaaatttgcagctcgctggaaattctacagcctcctcaagggggattgctaactcctgggaaaaaaaaaaa

SEQ ID NO: 15014 - DNA, 642 bp, Homo sapiens
atcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgggctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtaaattctcttgtctggctgcacccctttttcccgcccccagattgataagtaatgaaagtgcactgcagtgagggtcaaaggagggtcaacatatgtgattgttccataataaacttctggtgtgatactttcaaaaaaaaaaaaaaa

SEQ ID NO: 15015 - DNA, 523 bp, Homo sapiens
gagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatggaacaacggtgacctctccaggtcggcactttcacttcgtacggtggcaaaacga

SEQ ID NO: 15016 - DNA, 160 bp, Homo sapiens
ctccgaagcagcggtcatgcaggcttttgtgtggctgacgcttccctttttcacaacagtaaaaagctatcaatgggaaattgtggacttttcccaccagggactcaatggggactcaatgtgcaatattcagtcaacataaaactctttaagaactcat

SEQ ID NO: 15017 - DNA, 382 bp, Homo sapiens
cagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgtgcaaaggaggagtcaactaatgaagaaatgaataataaattttgacactgaaaaacattttattaataaagaatattgacatgacaaaaaaagaaaaaaaaaaaaa

SEQ ID NO: 15018 - DNA, 640 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggtaagaaaaatgaaagacacagacagtgaagaagaaattagagaagcgttccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcctgtacaaaattgtttaattgccttttcctttgtttgtaacttatctgtaaaagggttctccctactgtcaaaaaaatatgcatgtatagtaa

SEQ ID NO: 15019 - DNA, 251 bp, Homo sapiens
atctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagcaaaaaaaaaaaaaaaaaaaaaaaaaa

SEQ ID NO: 15020 - DNA, 634 bp, Homo sapiens
ggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacataggg

SEQ ID NO: 15021 - DNA, 456 bp, Homo sapiens
ggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcgggggggttgggttgctttgggtta

SEQ ID NO: 15022 - DNA, 471 bp, Homo sapiens
gttatgaaaattgcttgacttgcaacttcattggttgccttggagagtttataaaaaagttatttattaagttagaactttaataaaagactttttatttttatttatttattttttttgagatggagtcttgctctgtcaccaaggctggagtacagttgtgcaatctcggctcactgtaaccttggcctcctggcttcaagcaattcttttgcctcagactacccagtagctgggattacaggctcatgccaccatgtccagctaatttttgtatttttagtggagacatggtttcaccatgttggccaggctggtattgaactcgtgacctcaggtaatccacccacctcggcctcccaaagtgcttggattacaggtgtgagccaccgcgcttggccagacattgatatttaactgtttcttaatcaaattttgaacttatttcataccttgtatattctaaaaaaa

SEQ ID NO: 15023 - DNA, 352 bp, Homo sapiens
gtattctctaaacttttggtagtctaattaattaacaaggtatatgtagatactagggcactttgattaatgaattctcaagctgatataaatagaagacagaattgagcttctagaatgctttcggttggtaggtttcattatattgtttgagttatatagacacatatgtttgaatgacactgctcatggaatacctacatatcttcagcgtagataatgaagactatctgtcaaagtatcaaccaaaatcttgtctgtgagtatagataagagatgagaaatagactttaacggagaaagtcatttctttcaaattcatatttaggcaaataaacatcagaaaacatca

SEQ ID NO: 15024 - DNA, 505 bp, Homo sapiens
cttgcaggactcactgggtagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgccttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaa

SEQ ID NO: 15025 - DNA, 379 bp, Homo sapiens
agcattatgcttttcttggatacaaagctgccttgatatataataaacacagaattttttacagtcatcaagtgatgggctcccacatgttttgatctcaagcatagatcttttaaggttttttgaagtattgttggacaaagaacatttgagtttttgtcttcaagttatatttaccatactatttttggccaagtcccctttttgaaagttgttatatacctccttttacataaacctgaatattatttctaactcatgctttattaacctaagcttcattcatttctccctggaatatccctttaatagcttgcctgtacctcaggttgcccagtattcaaatttgctaggatatatacctactatatacccacaa

SEQ ID NO: 15026 - DNA, 493 bp, Homo sapiens
aaataaagtataggcgatagaaattgatacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacaccactaccaaa

SEQ ID NO: 15027 - DNA, 574 bp, Homo sapiens
tgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtcccagaactgtttgtttcaattggccatttaagtttagtagtaaaagactggttaatgataacaatgcatcgtaaaaccttcagaaggaaaggagaatgttttgtgggaccactttggttttctttttgcgtgtggcagttttaagttattagtttttaaaatcagtacttttaatgggaacaacttgaccaaaaatttgtcacagaattttgagacccattaaaaaagttaaatggcaaaaaaaaaaaaaaaaaaaaaaaaaaaaaa

SEQ ID NO: 15028 - DNA, 319 bp, Homo sapiens
atattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 15029 - DNA, 316 bp, Homo sapiens
gggatatatgtttgggaaaaaataacctaggctcttaccgtatgttgcacaaaaattaattcacaatggatcatagacttaaatgtaagtgaaaaaatgcttaaactttcagaactataaataactagggagttggagagagaatgtgggaagagttgaggtgttagttgtattcgagatatgttattttttaaatgatctgaacacatttgcagccaaaagttacagtggtgaaatttgaacgaggttacatgaatgtttgtgagagtctgtgctttcctttgtatataaaatatttactgattaaggtatagca

SEQ ID NO: 15030 - DNA, 400 bp, Homo sapiens
cattttatccttgggaacatgggagaattccaagcagagaagtaaaacaaggaggttttgaggaaaaatagaatggaggcatagagaccactgaggaggctactaaaatctgacctgggaaataatgagggcctggctagtgttgtgggaaagaaatagaagaaacgagacattttgaattagtaactgatggtactcagtgactaggtgggtaaaagaggaggagagggggaacgtggttgtttagtgttgccagagtctaaggcaaaggtataactaggtctgatgtcaaagtctagactccagtcttttggcttccctgagccacattggaagaagaattgtcttgggccacacataaaatacactaacactaacaatagctgatgagctagaaaaa

SEQ ID NO: 15031 - DNA, 513 bp, Homo sapiens
gcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggtatgggcaaaatcaataa

SEQ ID NO: 15032 - DNA, 473 bp, Homo sapiens
gaactcggtggtggccactgcgcaggaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccaactgtctatctatctggctggcagggaaggaaagaacttgcatgttggtgaaggaagaagtggggtggaagaagtggggtgggac

SEQ ID NO: 15033 - DNA, 560 bp, Homo sapiens
taaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcctgctggtctccagacacattcctgttgcattaagacttgaaagacttgtagatgtgtgatgttcaagcacaggatgctgaaagctatgttactatctagttgt

SEQ ID NO: 15034 - DNA, 384 bp, Homo sapiens
aacacaggggtgtacatcctcacatccaacacctcccagtatgacacatattgcttcaatgcttcaggttggttctcaggggggtgtctgttggcgtgaaaggctgtgggagcctggtctttggagctcagcttaagtggggattcatgtagcctccatttacgtaacaaatgctcactgaatatctgtacagcagagccaacattcctgtctccatggagcttacatgctaaattggggaggcaaacaataaacaaataaatattaagtaccattcaggactgtccaatcttttggcttccctaggtcacattgggagaagaattgtcttgggccccacataaattacactaaaactaagagtagctgataagctaaaacaca

SEQ ID NO: 15035 - DNA, 580 bp, Homo sapiens
gtcatttcagaagaagaaccaaaacacatctgatctgctcttaaaggaaactcaattgtgacaagcagaggaaactaaagaggtaagagtatttccttgctagtggtagaattggctctagaaccagaaaggttaaattataaatctttggcaaaacacagctttctttacgtcattttcctctgggactagatgagaaacagctgggtatttggctagagaaaccgctggaaaaactcacgttggttaacaacacttctcccagaccttcacatggtgattgcagttcatctcagctctaatgccacctcctcagagtctctttctctgacactcaaccccatgccctcttcttaaacatatcaccctcttcctttagggcacttatcacaatcgggaatgatcttatttatttgttaatagtctctcttctcacaaaacataagcaggatgagagcagagcccttgtctggcaccctcgctgttgtgtcctggtccctagacagtggtggcacagagtaggtgccaacacatatttgctgaatgaatgtacatgactgcatgatcatgtgctttctac

SEQ ID NO: 15036 - DNA, 396 bp, Homo sapiens
agcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggc

SEQ ID NO: 15037 - DNA, 406 bp, Homo sapiens
aggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgatttttggggtagcaatccaggagaaggtgctggagagggtga

SEQ ID NO: 15038 - DNA, 576 bp, Homo sapiens
  misc_feature 6: n = A,T,C or G
tagggngaaaaagatttttaaaacacaaagaaactctgggacccatagcacaatggtgtcccaaaagagagatgggagagcatgtggcacacaaacaaaagagaataaatagtggccaaaatttccgcaagtaggtgaaagatacaaatttatagatttagagaagttcagtgactcccaacttatgtgataactgcctcatatgtcttaaagaaattggacttatgtaaaaatttgcaggtaacattttatagtggtaaaatgtttaatatttcccccacatatcaggaataatgcaaagatgcacacagtcaccaccatttgtattcaacattgtattgaaggcctgattattgaaataataaaccttaattttcttttttcttaattgatctaacagatcatagttcggtcaaaataataatagcattgtattcagctatatcaataatcatcttaaacatcaaggtctaaataaacaaatttaaaaaaagagatttctgagtagataaaaaagtaagacccacctatatgttgtttgagaagaaactcactttatatataaagacacatccg

SEQ ID NO: 15039 - DNA, 310 bp, Homo sapiens
gaagcacacataaatttgatcactcgccaagcttggcgccatctacaaagctacttcatatttacagaaagttttctcaaatactgaggacaagttttggcctctagaggagttataggagctgataacttaatctgggggtaaatcctttgtgagaaatgaataattcaatcctttcctaatttgtctatatttctgtaaattatctccttattttcttttaaattgggatatggtcatctgttgaaacaattttgtagaagtaggaaaagaaaaagacttgggatcagaagatctggattcaaccatc

SEQ ID NO: 15040 - DNA, 485 bp, Homo sapiens
agatccatcagtttgaaaaattgtttgctatctctttgtagttggtctcctaccccagtctctggccccaggccaaacaaccactgatcttatttctgtcactatagattaaatttgtgtctggcctctttcacttagcataatgtttttgagatttattcatccatgttgttaagtgatcagtaaatttgtttctttttgttattagctaagattgatgaaaacctgaacctacaacttaaaaaaaaattgtaatgtcttcttgacattgattctttgtgggaggtatattgtgaaatcacagtgaatcttaagcattaaagtgggtcaagcagataactgttttagatatacttgactaatgttattttcttttgctttttttacttgaactgtaaaggtacaatgaaaaatattttaaaggcatcctcttggtaatttaaaagccctctcacactaaaaaaaaaaaggaatcccaaaaaaaa

SEQ ID NO: 15041 - DNA, 335 bp, Homo sapiens
tcatattaaaactatttcttccttatgtactggttacttatacctctttttgggatattagttcagtacgtttatacaaatctgagtgtgtgccacattggtgacatgtatttttgcagtaactttttgttttgttcttagaacatgtctaaagtaacacatgcactagtgctgtggtctgtggcaaaattactgtaattcaaattggaaaaaaaaatgtttccagactttgtccaacatttattcctatggcaaaggaaattactatgtaatactaatgatgcttatgctggtatgttttaagctactctatgaagtatgtgaaacaccaacat

SEQ ID NO: 15042 - DNA, 406 bp, Homo sapiens
gaaactattaaaggtattcagaaacgtgaagccagcaattgtttcgcaattcggcatttgaaaacaaatttgccgtggaaactttaatttgttcttgaacagtcaagaaaaacattattgaggaaaattaatatcacagcataacccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctgggatttttatgttttaatagca

SEQ ID NO: 15043 - DNA, 491 bp, Homo sapiens
aatcatgtaaagctgtgtaggccattggaggacttaagctttgacgctgaatgagttgggaaagcataagagggttttgagcagaagggtgacatgacctgacttatatgtttgaaggctcacctgggctgctgggttgagactagcctgtgggaaggatgcaagagcaaaagcaaggagatcagttgggaagctactgcaggaatgcaggggagagataaagtggccttgacaggaggaggagtggaagacggagggacacgtgggcagattctggatatgtgttgaaattggagacaagacgagtcactgatggatcagatgtgggatataaatgatggaaggatcaagagtgactccggagcttctccatggaattgccttttgctgagacggagaaaactataggaggaataaatttagtgggagctggaatcaagaagtttttgttcaatgctgagttttgagaatgcctttttagaaatccaaaa

SEQ ID NO: 15044 - DNA, 563 bp, Homo sapiens
gaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctgggctgcacccctttttcccgcccccagattgataagtaatgaaagtgcactgcagtgagggtcaaaggagagtcaacatatgtgattggtccataataaacttctggtgtgatacaaaaaaaaa

SEQ ID NO: 15045 - DNA, 239 bp, Homo sapiens
gtactgagtactgaatgctctgtcaggaaagggatgggaaatatcctagcagcaatactagaaaggaaaggcaccctattttaggacccattgattcccaccttgattgtatatccttcaactcgtctctggctcctcacttccactcagtcaaaagccacttcatatatttatccagacttccagccccaatacaaagaaagcaggagcatacaaaaaaaaaaaaaaaaaaaaaaaaa

SEQ ID NO: 15046 - DNA, 470 bp, Homo sapiens
gtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacacgattttccatattaaaaaattttcatttattttgtacctcattcacatgaatagtaatgtgacaaactaaagttaatacatgaagcattgcaatatggaatttgcacattttgtagcttacattatttgctgatacaacttttgg

SEQ ID NO: 15047 - DNA, 432 bp, Homo sapiens
aaaacttcagcatcagcttgcttcccttatttctaccttttaaaaaatagcttttaagagttctctttcttctaaatgaacacattaactaatgggctgttatattacttccaccatttctatgttttggagtgtcctttgtttcaaaaagttttcaatttgtatattctgcatatagattgctgtatagctatgtaaatttatatatatatatatgtttatcatataatttttgggaaataaatttacatttttagcctaataaggtgaaacaaaatggttagaccttgaacaatgtaatgtactcacaagtaataatgttatgtgactggattctgttttgtttatgaaggaaatgggaagacatgatgacctttggtccttattctacatgttggtggagtttgtggttggtcagctgccctggagaaa

SEQ ID NO: 15048 - DNA, 466 bp, Homo sapiens
tgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttaagcagatgtttaatttttttttttaacaacattaacttgtggcctctttctacacctggaaatttactcttgaataaataaaaactcgttgtcttgtcttctgcaaaa

SEQ ID NO: 15049 - DNA, 310 bp, Homo sapiens
  misc_feature 281: n = A,T,C or G
ctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttgnactacactgaattcacccccactgaaaaa

SEQ ID NO: 15050 - DNA, 230 bp, Homo sapiens
  misc_feature 15: n = A,T,C or G
gcctaaacggctacnttaagtcattggaaaaagaacaaacatctcaaaaggaaaaggaagtaataggattagagtgaaaactggtgagatagagaatagaaaaacagtagagaaaatctgtaaaaccaaaggtgatttttttaaaggtaatctttaaaaagatcaacaaagttgacaaacttttagccacacggaccaaaaaagaaaggctcaaattactaaaaaaaaaa

SEQ ID NO: 15051 - DNA, 182 bp, Homo sapiens
agataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggcaaaaaaaaaaaaaaaaaaaaaaaaaaaa

SEQ ID NO: 15052 - DNA, 351 bp, Homo sapiens
gctcgtcagtggcttcagttcacacgtggcgccagcggaggcaggttgctgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccccttaaggaggctcttcttagggaagctgagctaaggaaacagaggcttgaagaactaaaacagcagcagaaacttgacaggcagaagaaaaaaaaaaaaaaaaaaaaaa

SEQ ID NO: 15053 - DNA, 387 bp, Homo sapiens
atgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaaagaatctcttcacacgaaaaaaaaaaaaaaaaaaa

SEQ ID NO: 15054 - DNA, 521 bp, Homo sapiens
ggacatacatatgtacaagtggtatgtgatataaatcgtgtgtttcatatgcataatggtatttaacgtaattgtgaataggaagtaggtatcctaatttagtagtggttacttcatcaggcccatcccaggtgtttgtcgtgtcctgaaacaatttaaatagagacccacagagctaatgtttatccatttaaaagttataaatcaaaataacagattatctgaaaaaaaatctatcctgtacgtgtgaagatctaggcctgcctccatgttactccctttctcttactacctgtggctcatcccatgccatgaactgcctggggtacatatgtgaacactccagccttcagcgtaagtgatagtccaaattttctttaagcagctgctctccaagacagggccctggaaagaggcccacacatacagcccagttgctgcccagggctgttggactgtcatttcattgctcattgtacccagacagggatctgggccttcagagacttttgagaatataa

SEQ ID NO: 15055 - DNA, 469 bp, Homo sapiens
gaaagatgcttttaggatctggcatcgaaaatgtagagctcatgctctggaatccaagagttgtaagaatttccctgttctccttaagggctgggtgactttcagcaagttactttaaacttttcaagcctcagtttatcccccttagggattttctgatagttaaatgaaataataggtaaagtgcttagcacagaacctgatatatgataagagcttagtaaatattatttgttttttaatcttgatatttagaatttcaagttttcaacagcttttatgtacatctcttatgtacatgtgtattgccaaatgaaagcctgtttttcttcctaaaaatgactagatattatataactctatagataatgttcttatgagggcacacataatcaccaccactcacaatacctagttttgggaatctaattattccttccataatattttcctaaatctgctataatgt

SEQ ID NO: 15056 - DNA, 400 bp, Homo sapiens
cagcaacggggagcctgatgaggacgcttatgatatgaggaaagcactttccagggatactgagaagaaatccatcataccattacctcatcctgtgaggcccgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgcta

SEQ ID NO: 15057 - DNA, 222 bp, Homo sapiens
aaagaagaaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaatacaaaaaaaaaaaaaaaaaaaaaaaaaaaa

SEQ ID NO: 15058 - DNA, 510 bp, Homo sapiens
tggaaagaacatagcatttaggttatgagatatatccattttatactctgatagtcaccttgcttgtgtgacattttatcctataagtctataaaccgtatgtttgattatcattaaataatcatgtacattcttctgaaaccattccacagataacagctatcaaatgctattttatcatgaggtccagttatgatattttatatggagattagatcatttgcatgccttcttttattcccaggagagtcacatttctttttcactaaataaggaggggaagaaatcacagtcccattgctgtaatttctttctctccaatagattaagtttaatacctaacatgtagttaatattattatgtaaaatgtccagaaatggaaagctttgaagacaatgtaagtaagtggctgcctgcaggtggaggatgagaccagggatgaccggtccgtgggcatgagataatatgagaggaatgaaatgttctaaaaggtggttcataaaggaggg

SEQ ID NO: 15059 - DNA, 205 bp, Homo sapiens
gctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcat

SEQ ID NO: 15060 - DNA, 221 bp, Homo sapiens
aaaaaaaacaaagcaccccgccatttctagagtcgacgggccctgtgtccccaaacgggaagcccccgggttaacccgggccccctggaaccttaaatggaaaaaagaaaagggggcccttaaccccctggcaatcttttccgcccccttaaaaaaaaggaggtagggcccccggcgggaggaggaacccaccaaggggccttttttttacccaaaaaaaa

SEQ ID NO: 15061 - DNA, 350 bp, Homo sapiens
ctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtgg

SEQ ID NO: 15062 - DNA, 156 bp, Homo sapiens
cagtaaattccgggaaattcaacaggagctttccagtggaaggaatgaaggccagctgaatggtgaaacaaatacacccattgaaggaaaccaggcgggtgatgcagctgcctctgccaggagtctaccaaaaaaaaaaaaaaaaaaaaaaaaaaa

SEQ ID NO: 15063 - DNA, 306 bp, Homo sapiens
agagtcaagtgtccaacaccgtatgcctgtgaaagagctgggaacactagctgcgggtatgacgcccaattagggttctgatggtttgttggtgtcagtatataaagacaagatctcatgttcctggagatgcttagagcttaagatcgctgactgccctttaagaggccataggctgtgacccctagcacccacgtggagacttaagccatgtcataactcaaagggatcatctgacctgcgcaagtacacatgtggcacacagatatacatgcaggcaaaacacccatacatgtaaaattgatt

SEQ ID NO: 15064 - DNA, 265 bp, Homo sapiens
tcaaaagactgcctgtactaggagagagtaggtcccaaaggcaactttaaagttctggaaccaagacggagggcgaatatgggggcaaataaaaacaatagatacctcctaaaactctttttcataagtgttatttaaagccatcaaactgtccaggtgcagtggcttatatctgtaatcccagcacttttggagtctgagatgggaggattgcttgaggccagaactttgagaccagcctgggcaacatagacccctgtccctc

SEQ ID NO: 15065 - DNA, 546 bp, Homo sapiens
ttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatccccaaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagttttgaggggatatgggccttgagattccagacatttctaaatg

SEQ ID NO: 15066 - DNA, 412 bp, Homo sapiens
atagttgggcaggatgtaatagccatagcaattgatatttggtaagttttaattaacttaattaaccaaccggttggatttttaaaaacccatttttttttaacaaacagatgtgttcctctctttttgttttatttatgttttataggcgagcaattcgaactgcatttaaaaacagaaagcgggctgctattctgaccactcactatatggaggaggcagaggctgtctgtgatcgagtagctatcatggtgtctgggcagttaaggttgatgtctaaatagcgtgccattcaggggaagaggttgggggttggattttgaaagtcatcatttcaaaaacatggcaatagttagtaatttaaatgttaaatattttagtttttgagttagcttttgatagattgacttgg

SEQ ID NO: 15067 - DNA, 491 bp, Homo sapiens
agccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatggggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtatgaatccccatcattac

SEQ ID NO: 15068 - DNA, 486 bp, Homo sapiens
aactttggtggtaggtagaaaggggtgggaaacatctttgcaattttataatacaatctggccttgtttggacccaagttaaaacatctctgtggaaacaataaccaaacaaatagaaaaaactcatgtaaaggatttattttaaaatggtacctcatttgtaatggtctggaagtaaatagaaatccactttataagaaattactttcaattcaggcttcatagaattcctaaagataaagttacaagggaagtgagtgcataatcaaaaaaataaaacttccacatacaaacaaggagataaatcaccgtgaatgagaaccaacaaaaataatagcaataataaccagtagaaatttaacaaaataaatttatgcaatcataaaattagattaatatgtctaaagaatttgaagattggtagaaaaatagactatcaaatcagatttgaaaaatctaaatttaacaataaaatcactattttaa

SEQ ID NO: 15069 - DNA, 276 bp, Homo sapiens
ggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagttaaaaaaaaaaaaaaaaaaaaaaaaaa

SEQ ID NO: 15070 - DNA, 511 bp, Homo sapiens
ggcagatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactggccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagccctta

SEQ ID NO: 15071 - DNA, 561 bp, Homo sapiens
agggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaattagcctctgaataccttctccaattgggggaaaag

SEQ ID NO: 15072 - DNA, 467 bp, Homo sapiens
gggcgcaatagatatagtaccgcaggggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcagctcaacacccactacccaaaaaaa

SEQ ID NO: 15073 - DNA, 257 bp, Homo sapiens
gtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaaaaaaaaaaaaaaa

SEQ ID NO: 15074 - DNA, 222 bp, Homo sapiens
caagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaaaaaaaaaaaaaaaaaaaaaaaaaaa

SEQ ID NO: 15075 - DNA, 444 bp, Homo sapiens
aaataaacactccttttaaagacatctgagaactaggttaatattgtcccctattggtaagcccttgagattctagacacatatgactttttcaaaacccatatttaggatctaaaaagcagccagctgtgcttcatctctgagtcattctgctcttctcaatggagaccttattggcccttccttgtgctgtctgtgttggaggtgttccctagtcattgtaaaaataacctgtgagtgtattgaaatttttagaaggcttgaacaacagcaaaaaaaaaaccaaaaccaaaatatgtgttctataattacgtttaaatggcattttgaaattttcagaaggcttgaacaatagtaacaaaaagatgtattctacaatcacatttaaatggtggtgtggttttctaaaaggtcagaatattaatgttttatgggaaaaaaaaa

SEQ ID NO: 15076 - DNA, 300 bp, Homo sapiens
  misc_feature 38: n = A,T,C or G
gaattttcaaacaatagctttgtctaatgtggcagccntttttcagagtagcccaaaagttaatgtttaactttacctagagggtataatgttgtataaataataaactaatttaaaaggaaaaatttgcgttcatattttacgcatttatttaactattcagtaattcatagaaaatgtataaccattgtctaattttacagtattcttgaaagagggtgagtgcccgaactaaatatttagcagtgggaattataaaatcataaggcgattaagttagctagcgcagaattccaatat

SEQ ID NO: 15077 - DNA, 309 bp, Homo sapiens
  misc_feature 114, 188: n = A,T,C or G
ggtttgggtacaagtggcaacctgcttccatggccgtgtagaagcatggtgccctggcttctctgaggaagctggggttcatgacaatggcagatgtaaagttattcttgaagncagattgaggctgggagacagccgtagtagatgttctactttgttctgctgttctctagaaagaatatttggtntcctgtataggaatgagattaattcctttccaggtattttataattctgggaagcaaaacccatgcctccccctagccatttttactggtatcctatttaagatggccatgaagaggatgc

SEQ ID NO: 15078 - DNA, 310 bp, Homo sapiens
  misc_feature 280: n = A,T,C or G
agaactatttagcattgaaattagataatggttagctgaattctgttttctcaggccatttattattcacccagattacattctgaagaggctttaactcaatatcttaatacatttgattatcaatataagcattatataacttctctacataagatagttgaatcttaccaacaatgctagtgtaatgcatattgcagatgatcatgttacaattcagtttattacagaaaagtattgcgaatgatagagctatttggtacagctactcaacataatnggtcttgctttataccgataggattataaa

SEQ ID NO: 15079 - DNA, 400 bp, Homo sapiens
tctgctctcgtgctagctggagatacacttttgggctaatcggatcggcctcagcttgtctgcgatgttgaagcacaagggaagggtgccactatgacagaatattctgtgaactctcatgctcataaggacgtacctgtacatactgatgcagcctccactgtgtatatctaaatcatggaagatgactataagtaggtggtgttgaggattgcccttcgatcagaacgagctgaacttatctatgcccatctggaccagatgcgcacagcgtgactcttggctctgtacggagaattctataagagcttgaccattgtctgggacggatcacttgcagtgaagcatttttcagttgaaggacagttgggattcagagcccttctatttgggccacgac

SEQ ID NO: 15080 - DNA, 300 bp, Homo sapiens
  misc_feature 38, 179, 188, 203: n = A,T,C or G
tgatttgtaaaaacattgttactggaaatttattgganttgaggccttcctccagaaaataaggacttgattgtcaggcctatattaggttctgaaccttaatgccatgtatttgtacttactaaaaattgtttcaatgaaaagtacattagcagtatgaacttctggccagtggaagnttttccatntgaaaaatgtgatgnttgcatggactggttgaaacttttttattttctagcccctcccccacactggatagaatttagcctagaatttccctttggataaaagaacaaaaat

SEQ ID NO: 15081 - DNA, 300 bp, Homo sapiens
  misc_feature 78: n = A,T,C or G
gaacaagccggtcaggaagcccgcgcgcaacagccatggcttttaaggataccggaaaaacacccgtggagccggagntggcaattcaccgaattcgaatcaccctaacaagccgcaacgtaaaatccttggaaaaggtgtgtgctgcttgataagaggcgcaaaagaaaagaatctcaaagtgaaaggaccagttcgaatgcctaccaagactttgagaatcactacaagaaaaactccttgtggtgaaggtctaagacgtgggatcgtttccagatgagaattcacaagcgactcatt

SEQ ID NO: 15082 - DNA, 268 bp, Homo sapiens
tggaaggccaaggcaggctggatcacttgagccccggagtctgagaccagcctgggcaacatggcaagaccccacctctactaaaaataccaagattagccgggcatggtggtgcttgcctgtggtcaacagctacttgggaggctgaggtggggaagatggtttgagcccaggaggcggaggttgcagtgagccaggactgtgctgctgcactccagcctgggtgacagagcgagaccatgtcccaaaaataaaaaattgtttttaa

SEQ ID NO: 15083 - DNA, 508 bp, Homo sapiens
ggcgaatatgatttttatgaatataaagaatatgaagataaaccaacaagcccccctaatgaagaatttggtccaggtgtaccaagcagaaactgatattacagaaacaagcgtaagttgatactatgcactgtgtcattgtatgtcttatttatgggatatttttatgtccatgtccatcttaatgtcttttcaggtttaaaatgcaggttgaatttttatgtaaattatgaatgcctattaccactaggacaccttgttagattctttcacatgggaatcttcagcagttgtatctttggccatacttttggagtcattatttgaaagtaaaatcttgaatagaattgcatcagaaattttgtcattgataagattaaaccatagttgtttttattccaagtagcaagtctgattttttatttctgatttttagactattttttaaatttaatttgatgacatttcttaatgcctggggaataataactgacatctatagatgtca

SEQ ID NO: 15084 - DNA, 471 bp, Homo sapiens
gcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaacatttctgaagcccgatggggcaaaca

SEQ ID NO: 15085 - DNA, 572 bp, Homo sapiens
cttcaggagctgcgtgcccatgagaatgagatcaccaaagtgcgaaaagttactttcaatggactgaaccagatgattgtcatagaactgggcaccaatccgctgaagagctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttggagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaa

SEQ ID NO: 15086 - DNA, 419 bp, Homo sapiens
gcagatggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgaa

SEQ ID NO: 15087 - DNA, 592 bp, Homo sapiens
ggacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctaaatcattctcatttacttaattgaggagtaggagactaaaagaatgttcactctttcaatttcctggataagagttctggagatggcagcttgttggacacatggatttccttcaagatttgcaacttactggctagctctggcttttttaatgcagggagaaaaagcccaagagttcactg

SEQ ID NO: 15088 - DNA, 350 bp, Homo sapiens
gtagtcccagctactcaggaggctagggtgggaagatcacttgaaaccggagttcaaagctgcagtgaactgtgattgcaccgctgcattccagcttgggggacagggtgagaccctgtctcaaaaaaaaacaaccaaaaaaaactatataattttgtgtggaaaatataggtaaatatatttttgactttggggtagtgaaagactccttaagccacaaaaagaatttaaaaagaaatgatgaacatacttgaccatatgaaaattagaacctaaatccataaaccttaagaaagtgaaatctaaactacaaactgggaaaaaaaaaaaaaaaaaaaaaaaaaaaaaaa

SEQ ID NO: 15089 - DNA, 255 bp, Homo sapiens
aaggggaataagtatctcacatggcaggagcaagggcaaagagagggggagggaggtgccacacacttaaccagatcttgtgagtactcaggtcttgtgagggttgcttgaggtcagggataccccatttaccctgatgtgttcatatacatttcatgactgtatcaaaatatctcatgtacccccataaacatatacacctagtatgtacccaaaaaaattaaaaataaagtaaaaatttaaatggtaaaaaaa

SEQ ID NO: 15090 - DNA, 475 bp, Homo sapiens
gaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaatttagaaagcgttcaagctcaacacccactacccaaaaaaaa

SEQ ID NO: 15091 - DNA, 467 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatccttttaaaaagagattaaaccg

SEQ ID NO: 15092 - DNA, 148 bp, Homo sapiens
tcccagctactctggaggctgaggcaggaggatcacttgagtttgggaggtcgaggctgcagtgagttgtgattgcaccactgcactacagcctgggcaatgggagttagaccttgtcttaaaaaaaaaaaaaaaaaaaaaaaaaaaa

SEQ ID NO: 15093 - DNA, 508 bp, Homo sapiens
gaattcgtgatgctgacagcattcgggccgagatgtctcgctccgtggccttagctgtgctcgcgctactctctctttctggcctggaggctatccagcgtactccaaagattcaggtttacccacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtacgcctgccgtgtgaaccatgtgactttgtcacagcccaagatagttaagtgggatcgagacatgtaagcagcatcatggaggtttgaagatgccgcatttggatggatgaattccaaattctgcttgcttgcttttaatattgatatgcttaaacacttacactttatgcacaaaatgtaggg

SEQ ID NO: 15094 - DNA, 190 bp, Homo sapiens
atacaaaaaaaagtagccaggcttggtggcaggcgcctgtaatcccagctacttgggaggctgagacaggagaattgcttgaacccaggagggagaggttgcagtgagccaagatggtccactgcactccatcctgggcaacagagggagactccatcccaaaaaaaaaaaaaaaaaaaaaaaaaaaaaa

SEQ ID NO: 15095 - DNA, 444 bp, Homo sapiens
gaggcattgaggcagccagcgcaggggcttctgctgagggggcaggcggagcttgaggaaaccgcagataagttttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaggcga

SEQ ID NO: 15096 - DNA, 422 bp, Homo sapiens
aaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaaaaaaaaaaaaaaaaaaaaaaaaaaa

SEQ ID NO: 15097 - DNA, 155 bp, Homo sapiens
ttctgatttgctctatttcagcagatcttttctacctactttgtgtgatcaaaaaagaagagttaaaacaacacatgtaaatgccttttgatatttcatgggaatgcctctcatttaaaaatagaaataaagcattttattaaaaaaaaaaaaaa

SEQ ID NO: 15098 - DNA, 339 bp, Homo sapiens
aaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataagggaaaaaaaaaaggaaaaaaaaaaaaaaaaaaa

SEQ ID NO: 15099 - DNA, 300 bp, Homo sapiens
  misc_feature 185: n = A,T,C or G
gtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgntttccatgcttctctggcaccttggattatatataaaaatacaggaaatagataaacatgaatgtgattaataatgctgaaaaagtattaagcctaccaaagacacactcaggct

SEQ ID NO: 15100 - DNA, 256 bp, Homo sapiens
  misc_feature 29, 254: n = A,T,C or G
gcctttgagcaaatctgcatcttctcttnatttctgacctttttccatgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttanct

SEQ ID NO: 15101 - DNA, 300 bp, Homo sapiens
acaataccagtcaggatgtagccatggggaaggatttcatgacaaaaacgctaaaagcaattgcaacaaaagcaaagacaatcctaagcaaaaataacaaagctgcaggcatcatactactggacttcaaactacactacaaggctacagtaaccaaaacagcatggcactggtacaaaaacagacacatagacccatggaacagaatagagaactcagaaatgagaccacatgcctacaaccatctgatcttcgacaaacctgacaaaaacaagcaatggggaagggattccctctaat

SEQ ID NO: 15102 - DNA, 301 bp, Homo sapiens
  misc_feature 12: n = A,T,C or G
taagaccccgcntctcatctgttcaatggggatatgaacatctacaagtttatggtaaagtttaaaagcacatttgtctgatactaagagccaataaacaatcgttactttcattaccccagttggcaatttgagcagggcatgacagggagtttgggtgacaggcgataaagtaacggacattatggaaagtctgaaagaatgtaataaggataatatattttagatgtatttttctcttttatattttgtgaatgacttttcccctggttagcctaaggtaattcttatgactcaggaa

SEQ ID NO: 15103 - DNA, 300 bp, Homo sapiens
  misc_feature 30, 200, 275: n = A,T,C or G
acaggctgttacttcactacaactgacganatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggngtgtgaatttgaaggcggcatctcgcaacttacaagcagctagaggcaggcagaaaaattggatttcatgtctgngctgctggatggatgctaaggcaga

SEQ ID NO: 15104 - DNA, 430 bp, Homo sapiens
aagcgtcacaagaaatatggcccggcccgattagcttatcgctacgtgggccgggccatgatgatgccctccacagttctagcttacacccagctgggcaccttcatgatgctcatcatgtgtatcagttgggctatcgccaccttatttttccagtgcatgtgccggtgccttggaccacagggtccctgtggtcagattccttaacctagaaaactactgtgcagtgccttttcccatgccttgtatacaagtcccagtgacaagggacaaagcaaaacacataccataaatgcttatcatttatatcccaggggcccaaaatctgaactggagcatgagttttatgaattgtgaacctgatggcttcacacagctgcactgcccctgagaagaccacttatgaagagacccacatctgctctgaatt

SEQ ID NO: 15105 - DNA, 300 bp, Homo sapiens
  misc_feature 96, 100, 110: n = A,T,C or G
cagcagcgtcgcagcaggagaatatgcagggcagagccgaggagaacccccgctccctgaggaggacctgtccaaactcttcaaaccaccacagcngccngccaggatgngactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaata

SEQ ID NO: 15106 - DNA, 300 bp, Homo sapiens
  misc_feature 10: n = A,T,C or G
gatttagtgngctctgattattgttattgcagaaaaacaagttcatcattcaaaacaatttgctgaggcattccttttggataagagatcctggttaatctgcattaaaaagtcagtcacattaataaagtttaacgcagttcatctagtgtctgaagtttctacaatttggagattaacatttggtgcctcaatgcaatgaccctttcctggttgctcctctgaaagttactgcctgtaggcagagcgtagttgcactgaagagtcatgaaggacatttgaatcaatgtcagtggaaaa

SEQ ID NO: 15107 - DNA, 544 bp, Homo sapiens
atacgagaatcatctaagactgatggatcactgtcccgattcaaattattcttcagtccatttccccttcctatttcagctgttccttttcacctaactgttcagtcattctggttttcaagcagtgctttatctcatgtccttgaatatagttgtgtaactttatttttttaggtaataattagaacagttcccttcagaggctgcatttgccttcttctgccacctaaatattacttcccttcaaatctgcctttgaatcatcatcatttaaaaaaaaattaacatgtttttgttgtagttatcttctggggtttcaattcctcagaaacaacttttttcacaacggaaaggaaagaacactagcgttctttcagtaaagtacaaagtgtttattttacaaaagagtagtactcctgagagcaattcaaatcatgctgacaaggatactgatagaaaaagtgatttcttcttattataaagtacatttaaagttcaaggactaaccttatttatttgggaaagggggaggaggaaggaaatg

SEQ ID NO: 15108 - DNA, 250 bp, Homo sapiens
gagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatatatgtacagttatctaagttaatttaaagttgtgtgtgcctttttattt

SEQ ID NO: 15109 - DNA, 456 bp, Homo sapiens
ataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatacccatcgtcctagaattaattcccctaaaaatctttgaaatagggcccgtatttaccctatagcaccccctctaccccctctagagccaa

SEQ ID NO: 15110 - DNA, 541 bp, Homo sapiens
catgtccaaatcgatgtggatgtttccaagcctgacctcacggctgccctgcgtgatgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctgggatcactccctc

SEQ ID NO: 15111 - DNA, 437 bp, Homo sapiens
ggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgccgttccaccaaatacaattcaaatgctttttgttttatttttttaccaattccaatttcaaaatgtctcaatggtgctataataaataaacttcaacactcctttatgataaaaaaaaaaaaaaaaaaaaa

SEQ ID NO: 15112 - DNA, 227 bp, Homo sapiens
gagtcttagttcaactttaaatttgcccacagaaccctctaaatccccttgtaaatttaactgttagtccaaagaggaacagctctttggacactaggaaaaaaccttgtagagagagtaaaaaatttaacacccatagtgggcctaaaagcagccaccaattaagaaagcgttcaagctcaacacccactacctaaaaaaaaaaaaaaaaaaaaaaaaaaaaaaaa

SEQ ID NO: 15113 - DNA, 332 bp, Homo sapiens
gttgggattacaggcgtgagccaccatgcacatccaaagtaatagccattttattttaaaaaataaaaataatggtcatcctagcctgagcaatcaggcaagagaaagaaataaaaggtactcaaataggaaaagaagaagtcaaaccatctctttttgctgacaatatgcttctagaaaatcctaaaaactcctccagaagattcctagagcagataaatgacttcagaaggatacaaaatcaatgtacaaaaatcagtagcatttctatacattgataatattcaagctgacaaccaaatcaagaatgcaaacccattaacaacagcctc

SEQ ID NO: 15114 - DNA, 134 bp, Homo sapiens
tacctatgttggattctgtgtctatgcgggattctttggatttgccttcgggtggctcagctccgtattgtttgaaacaattgatggaccttgttggaccccagaggtttctccagcgctgtggggattggtga

SEQ ID NO: 15115 - DNA, 384 bp, Homo sapiens
gccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctcctcgccgggcagcttgggagaaggcgcaatactctccaagctccaaccgttaccggctaaataataaagtaaaagtttgtaaaaattcatacttaaataaaacaaattttagggacagtcc

SEQ ID NO: 15116 - DNA, 338 bp, Homo sapiens
tcgccgcgatggtgctgttggagagcgagcagttcctgacggagctgaccagacttttccagaagtgccggacgtcgggcagcgtctatatcaccttgaagaagtatgacggtcgaaccaaacccattccaaagaagggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagca

SEQ ID NO: 15117 - DNA, 599 bp, Homo sapiens
gagtagacttgaatatgcctctgggcaaagaagcagagctaacgaggaaagggatttaaagagtttttcttgggtgtttgtcaaacttttattccctgtctgtgtgcagaggggattcaacttcaatttttccgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggtcaagaggacagtgatggtgacttaagtgtgaattggagtatgcaccaactgaggtacattgggcataaaagaagatatgagtgagcctcaggagaaaaaactctcagagaacactggattttttgg

SEQ ID NO: 15118 - DNA, 305 bp, Homo sapiens
ccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattacggtgggtgattattttttatactgtatgtgccaaagctttactactgtggaaagacaactgttttaataaaagatttacattccacgaaaaaaaaaa

SEQ ID NO: 15119 - DNA, 179 bp, Homo sapiens
catcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtgg

SEQ ID NO: 15120 - DNA, 120 bp, Homo sapiens
ggtgcgtgcgggcggctgcgtcaggctgcaggagaagatggcggtctccacaggagttaaagttcctcgtaattttcgcttgttggaagaacttgaagaaggacaaaaaggagtaggcga

SEQ ID NO: 15121 - DNA, 348 bp, Homo sapiens
accatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgaggggagaaaaaaaatctctttttttct

SEQ ID NO: 15122 - DNA, 547 bp, Homo sapiens
atatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtgggttccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaaagagccgggtggcagctgacaagaggaagccgctcaaataccttcacaaataaatagtggcaatatatatataagtttaagaagg

SEQ ID NO: 15123 - DNA, 516 bp, Homo sapiens
actgcagcactgttcacaatagcaaagacatggaatcaatctaaatgtccatcaatgacacactggataaagaaaatgtggtacatgtgcaccatggaatatatgcagccataagaaagaacaagatcatgtcttttgtgggaacatgaatgaagctggaggctatcatccttagcaaactaatgcataaacagaaaaccaaatactgcatgtcctcacttattagtgggagctaaatgataagaacttatgaacacaaagaaggaaacaatagacactggggtctgcttgagggggaagggtggaagggagaggagtagaagagataactatcaggtactgggcttaatgcctggtggatgtaatatgcctacaacaaatccttaatacatgtgtttatctgtgtaacaaactttcacatgtaccccaaacatcaaataaaaatttttttaaaaatctaataaaaacgctaagggactattttaaaactagctaaaaagcataaaggaaagtcca

SEQ ID NO: 15124 - DNA, 468 bp, Homo sapiens
aatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatat

SEQ ID NO: 15125 - DNA, 318 bp, Homo sapiens
caaaatgaaggggagaaatagacagcaaccccataataacagtaggaggttaatactcaactttcaataatgaatagaaaatccagacatattaaccatgaaacagaattgaacacccttatagaacaaatgtacctaacagacatatacactttatagtaataaatacttacatgtagggaaaagaaaaatcttgaataaaaatgcactgtgcacaccaaagacatagcaaaagaagagaaactaaacctaaagttaacagatcaaagggaaaaacaaattcagaccagaaataagtgaagaagtataaacaaacaa

SEQ ID NO: 15126 - DNA, 317 bp, Homo sapiens
gggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccacca

SEQ ID NO: 15127 - DNA, 150 bp, Homo sapiens
catccttaactcctgtactttacttctaaacgttgttaatggagataaatcttagaaccataagattttcccagatcctcccttctcccatccaaagagaaaaaggaaattaaaaaaaaacaaaaaaccccaaaaaaaaaaaaaaaaaaa

SEQ ID NO: 15128 - DNA, 350 bp, Homo sapiens
gaagtttttaaaattaaagtctaatcagtatcttttgtaactgcttctgctgtgtggttaaacccggtctcaaacggttatggtcccagctttctcactaactgctattttccaagaaatatacactacatttacgttttctataatacagtgattttagcaacactgctaaaacaacattcagcattttgcctttgtatttcctttgtattattctaaatagataaccattgtcagaagacatttcttgagccctcaatgaggggaggaaaaaattataattcttagtcttttcagcttgtcactacatcaataattaactaaaaaaaaaaaaaaaaaaaaaaaaaaaa

SEQ ID NO: 15129 - DNA, 569 bp, Homo sapiens
gggggcagaagaggaatcaaataaggcttcaaggaagtgatgacacttgagtgattttaaattcccagacacctgagaatttgtaaaatcagaaatggagagaatattccaagtagaaaagatagcttgaacccagaagatgttaaggttgactttcagcaaagcttgaaaaatagcatataataactgttcttatatatataatgtagaagaagcacaaaagagagaagacgactagttttaggaaactgctgatataaggattatatcattccaggtcaatctcgtatgttgaacacagagggaaaaattctaaataagagcaaacgaatccagcaggatattaaaataactacattgtcactaatgagccttacctaaggaatgcaaggatagtatgaagttttagaatctatcagtataggtctggcacagtggcccatgcctgtggtctcagcgctttgggaggccgagacgggtggatcgcttgagcccgggagttcgagaccggctggggaatgtggtgaacccgtctcacaaaaatacaaagtagcatctcacatgtggtc

SEQ ID NO: 15130 - DNA, 424 bp, Homo sapiens
cagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatgggagtaatgggtacttttattctttcttgatagaaacctgcttacatttaaccaa

SEQ ID NO: 15131 - DNA, 383 bp, Homo sapiens
gtggggaccgcggggcggacgggagcgagtatgtccgctctgactcggctggcgtctttcgctcgcgttggaggccgccttttcagaagcggctgcgcacggactgctggagatggtggagtccgtcaatcctgaatgaataatataattggtatatgaggacattacggaaacagtatgctacgtcattcaagttgtaaagtggcgatatttgtgccggtggtggtgtgcacattgagccccggtatagacagttccccagctgaccagatcccaggtgttccagagcgagttcttcagcggactcatgtggttctggattctctggcgcttttggcatgactcagaagaggtgctgggtcacttttccgtatccctgatcc

SEQ ID NO: 15132 - DNA, 390 bp, Homo sapiens
gtaccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaaattgatatttaacacttacccactcccctttccccatctcttctaccgctcttgttgatcgtggtatctgatcttgactagataggctgaaggcacatggttccctccaaaaaaaaaaaaaaaaaaaaaaaaaaaaaa

SEQ ID NO: 15133 - DNA, 223 bp, Homo sapiens
aaagagcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgaggaaaaaaaaaaaaaaaaaaaaaaaaaaa

SEQ ID NO: 15134 - DNA, 300 bp, Homo sapiens
aggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactcccctgctccccagccttatgtttcttttaatgcttctg

SEQ ID NO: 15135 - DNA, 145 bp, Homo sapiens
tatttcagcagatcttttctacctactttgtgtgatcaaaaaagaagagttaaaacaacacatgtaaatgccttttgatatttcatgggaatgcctctcatttaaaaatagaaataaagcattttgtgaaaaaaaaaaaaaaaaa

SEQ ID NO: 15136 - DNA, 153 bp, Homo sapiens
ccttgctgcactgttgcagtcattctgaaaggacctttccctgtacttacctttcaacatgcttcaatcttatcaacgctacattttgtatttttcaaacaagtataaattctgcaataaagagatgtagtttttttttaaaaaaaaaaaaaa

SEQ ID NO: 15137 - DNA, 295 bp, Homo sapiens
gaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaaaaaaaaaaaaaaaaaaaaaaaaaa

SEQ ID NO: 15138 - DNA, 537 bp, Homo sapiens
atttaaggatagtgttatctacacttgaaagttaaagtatggaggagcagcttgatctaatggaagctctggctttaagagtccagagagcaagattccagtctctgctgtttcattaactttagttaactgtacaaatcctgtgtctgagtacaatatatgcactttttttgtaccatggtttctttatgctaatgtctgtcatggtaaattacattcttcagttctcatgttagatgtttgtcttcggatcacaggtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactgtaagtagtgttggaaattaacagcaagacagtttttagtagggattgctgtttatgcagctctgggaatacaatttta

SEQ ID NO: 15139 - DNA, 451 bp, Homo sapiens
gagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaa

SEQ ID NO: 15140 - DNA, 538 bp, Homo sapiens
ggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcacagctagtgatgg

SEQ ID NO: 15141 - DNA, 428 bp, Homo sapiens
atcaaagacacatgtatatattttaaaggcattttttcttctccccaactgtatgtatagctagaatctgcttgctgtgtaaccttttcttctgcatggagcttttggtgaagcaaggccatttgtccagtgtttcatagccttaagcatgtttgcccttcgttttttgaatgttcaaaaaatgtttaagtgatcaagaaaaagctctaactttcgacttttgttaattttatgacatgacactggccaaaatattgtttcaattactgttgagccattcttatcatttccctgacataaaatatgcaatgttttagacagtattctaccaagagtctctcagacaatttttacaaaaactctttttttccattatgcactggataataacagtatcagtgtctatgttcctaaagttccttttttaa

SEQ ID NO: 15142 - DNA, 289 bp, Homo sapiens
agacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagataggaaatgaaaaacaagctaagacaagtattggagaaaaaaaaaaaaaaaaaaaaaaaaaaa

SEQ ID NO: 15143 - DNA, 534 bp, Homo sapiens
gtgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttggctatctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactgggtctctgtttgttttcttcaatcaccccaaagggtcgcga

SEQ ID NO: 15144 - DNA, 303 bp, Homo sapiens
gatcaatataattgaatgaaaaagaaagctgaaggacattccaagaataatataaacataagctattttaaaacattagagggagtgctttatgcaaaagagaaactgaatttattgtttcattctctcttctctcccttcacccctttcaagaaaacgcaaagccacaagtgagtggttgtatgtgtctgatggcttatgtaaacatagaagaagtcttcagatggctaaaataaacatgcgcgtgttaccaaaggatatgtttacacaaaccatttgctcagcctctgaaataatgaataa

SEQ ID NO: 15145 - DNA, 392 bp, Homo sapiens
gaccgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacagg

SEQ ID NO: 15146 - DNA, 293 bp, Homo sapiens
gaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttaaaaaaaaaaaaaaaaaaaaaaaaaaaaaaaaaaaaaaaaaaaaa

SEQ ID NO: 15147 - DNA, 345 bp, Homo sapiens
gttcgtagaaaattcaagggccaaatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgaaaaaaaaaaaaaaaaaaaaaaaaa

SEQ ID NO: 15148 - DNA, 466 bp, Homo sapiens
aaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgaattggaaacctgccgacttagtggcggtgatag

SEQ ID NO: 15149 - DNA, 291 bp, Homo sapiens
  misc_feature 291: n = A,T,C or G
aagagggaaaaaaaattaaaaaaaaacattaatctcaacgtatttagaaaactatttgacaaaattttacatccattcatagtaaaactctttagcaaactagaaatagaaggagacctgtgggaactccacagctaacgtcatacttaatctggagactgaatgctttcccaccaggatcaggagcaaggtaaggatacccactgtcaccacttttgttcagcattttgctggagctcttaccctgtgcaattgcataagaccaaaaaaaaaaaaaaaaaaaaaaaaaan

SEQ ID NO: 15150 - DNA, 144 bp, Homo sapiens
ttaattatagcaaggtcacataacacaaagttagtatacaaatgtaattgctttcctatatatcagaaatgaacaactggaatttgaaataaaaaatagaccattcacatttgcaccaaaaaaaaaaaaaaaaaaaaaaaaaaa

SEQ ID NO: 15151 - DNA, 302 bp, Homo sapiens
  misc_feature 7, 31, 45: n = A,T,C or G
gtgctgncttcatcagaatcaaccaggagtntatccgaacgtttngcagtcagcagactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattc

SEQ ID NO: 15152 - DNA, 262 bp, Homo sapiens
gcagcaaagagacacaccacgaactaatattacacaagtgtatgcacagagacttgaaaaaccaggaaaaaaactagataattgtataatacataatttactaaaattgatactggtagagataaatagtctaagcatgccaattttcacaggactagagaaaaattgtagagcccctgaaaaggaaccaggcccatgcagtttttcagaaactttttcaaacctttaaagaccaaaaaaaaaaaaaaaaaaaaaaaaaaaa

SEQ ID NO: 15153 - DNA, 288 bp, Homo sapiens
agtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgttaaaaaaaaaaaaaaaaaaaaaaaaaaaaaa

SEQ ID NO: 15154 - DNA, 392 bp, Homo sapiens
ttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacatttttttttttgagctaaagtcagggaatcaagctatgcttaatatttaacaatcacttatatgtgtgtcgaagagtttgttttgtttgtcatgtatgggtacaagcagatacagtataaactcacaaacacagatttgaaaataatgcacatatggtgttcaaatttgaacctttctcatggatttttg

SEQ ID NO: 15155 - DNA, 509 bp, Homo sapiens
gaagttgcatttagaaaattcaagctgattactgaagatgttcagggtaaaaactgcctgactaacttccatggcatggatcttacccgtgacaaaatgtgttccatggtcaaaaaatggcagacaataattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaatgaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactgggggacgagaca

SEQ ID NO: 15156 - DNA, 535 bp, Homo sapiens
catattcttgaagatctatattgtatgggactgttaagagaaaataacactgaatttaaatatgcttctttttttcttatggacctttgagtagaataaaattcatttgtcaattttgttttgatttttattttagtaaatctgaagaattcacaattttattgggttccttttgatttaactggatgattatccccatttaatgtgaactgatacatttttcctaggttattcatattagtaccaataaaagtaaaaaatttatgaaaaaatatataatgctacatggaaatatcatttacatacacaaaaaaaatttatcacatcatataaggcaaaaatttactgatttaagaagtatgttgaaattgttagagttcatattgaattgggaagggatatttgattcttttatggggaaatatacctcatatctttagaattgggtagagcactaaaaacctcaaaaatgacttgtagtaccacttctctaatacatacatgtacatttatacatacatatatacacacatgt

SEQ ID NO: 15157 - DNA, 302 bp, Homo sapiens
  misc_feature 28, 56: n = A,T,C or G
cttgaaagggaaaatatccatgtcaggntctttcatagtagaagaatggctgcttntgaatggggaggaaagaagacatttttcttaatatcctttttgtcccatctctaaaatgtataaatattttgatttggttttactttaatttctcattcataatttcgcaactgtccttttgggttgcctccaacacattacttccatttcagaaaccatatctgatttaatataaactgctaacttaagaagaggtgaatttgcatttacacttagacactttctaaaaacagggtgaacttaat

SEQ ID NO: 15158 - DNA, 264 bp, Homo sapiens
gaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaaaaaaaaaaaaaaaaaaa

SEQ ID NO: 15159 - DNA, 393 bp, Homo sapiens
tcagttgaaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcaccccccaacccaagaacttgggccgagcccctccgtgaggaacacaatctcaatcgttgctgaatcctttcatatcctaatagggaattaacctccaaataaaacatgactgggt

SEQ ID NO: 15160 - DNA, 521 bp, Homo sapiens
gaggcattgaggcagccagcgcaggggcttctgctgagggggcaggcggagcttgaggaaaccgcagataagtttttttctctttgaaagatagagattaatcaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgaagaaaagaatagagaagatagggaaattagaagataaaaacatactttttagaagaaaaaaagataaattttaaaccgg

SEQ ID NO: 15161 - DNA, 359 bp, Homo sapiens
atttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagattacgtacataacctaaacctactccaatgctaaaactaatcgtcccaacaattatattactaccactgacatgactttccaaaaaaaaaaaaaaaaaaaaaaaa

SEQ ID NO: 15162 - DNA, 226 bp, Homo sapiens
atagaaaaaatttgtaagttgaacttcattgaaatttaaaacttgctctgtgaagtatgctatttaaaaaataaaaatacaaattacagagtgggagaaaatattttcacatcacatatcaaacaaagatcttgtagctagaatatataaagaagtcttaaaattcaaccaaattaaaaatgggtaaaaagttgaataaacacataaccaaaaaaaaaaaaaaaaa

SEQ ID NO: 15163 - DNA, 319 bp, Homo sapiens
gtctgtcatcagctgagagacacttggtagtttcactttttggccctgtgaataatgctgctatgaacctttctttacaagtgtttgtgtggacctgcttagcaatttccttaaatatgtggaatgacatccccctcggatgttggtaactaaagcttttctgtttttttgatatgtaccttttgccatgataagaagctgtcattgaattcaggagtttcaagaattgtgtgtaaaaaacatttggaataaaaacctccaccttaagatgcaaaagggtaaaaaagaaattttccaaaaaaaaaaaaaaaaaaaaaaa

SEQ ID NO: 15164 - DNA, 514 bp, Homo sapiens
acatcagttttacaatataactacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgcctgcattgttctagagtgaaacaggtgtcaggctgtcactgttcacacaaatttttaataagaaacatttaccaagggagcatctttggactctctg

SEQ ID NO: 15165 - DNA, 533 bp, Homo sapiens
atttgtggttattttagagtttgcagtatacatttatagttaatctaagatgactttcaaacaatagtacaggcatacctcagagatattgcatgtttggttccagatcaccacaagaaggcaaatatcacaataaagcaagtcacataaatatttttgtttcttaagtgcatttaaaagtaatgtttacactatactgtagttaattaagtgtgcaataacattttgtctaaaataaaaaggtacataccttaattaaaaatgctttactgctaaagatgctaatgatcatctgaacctttagcaagtcatcatctttttgctggtgaaaggtcttgcctcgatattgatggctgctgactgatcaggatagtggttgctgaaggttggggtagtcatgtcaatttcttaaaataaggtaatgaagtttgccacatcactggactcctcctttcacaaaagattttgctgtagcatgagatgctgcttgataccattttaccccacggtagaacttctttcaaaaattggga

SEQ ID NO: 15166 - DNA, 302 bp, Homo sapiens
  misc_feature 262: n = A,T,C or G
acttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgcatttaaaagntcattttgagggaataacatgtaatataatttgaaataaa

SEQ ID NO: 15167 - DNA, 300 bp, Homo sapiens
actacccttccaaaacagctccccaccccattttcctcttccttataaagagggtgtttgaatttcagccatgtgtccttgctttgagtctcatatttgtgggattcccatgtccatatgcatatgaaatttgtgtgccttttctcctgttaatctgtcatagctcatttcagcaaaccttcagagaggaaagaaggaaagctttacttccatctctgcaatctgtagattacttataatacctaatacagccaggcatagtggctcacacctgcaaccccagtgctttgggaggctgag

SEQ ID NO: 15168 - DNA, 399 bp, Homo sapiens
acttcctgaagatgtccttgatgtccagctggcattcttcgacttctctccagccgagcttccaagaccatcacatatcactgcaaaatttgcattcgcatacagtggactcaggcccaggtggaaaagtgtaagggagggcccctgagcgctgttgggtcacattttaaggggtgattaacagggtcttaggggataccgcattttatcctctacagatgctctagagtaggggcacacgcacacactggggtagtgcagcaacaaagtacttagaatagtcgaccacgcacgactctacgacctaccttttggagatactaccaccgtacggcacgggtcgtcctcatcaacaagtttggtctgggcgccgccctgctttctttttccccaaccttt

SEQ ID NO: 15169 - DNA, 228 bp, Homo sapiens
gagatgtctcgctccctggcccttagctgttcctcgcgctactctctctttctggcctggaggcaatccaccgaactccaaagattaaggttaactaacgtaatccagaagagattggaaagaaaatttcccctaaattcctatgtgtctgggttcacacacacccgcacattaaggttactttctctgggaggttgggagagagttttgaaaggggggctttataca

SEQ ID NO: 15170 - DNA, 161 bp, Homo sapiens
ccaagttctttcctttacgttcattcagaatactttgaatagggtctcccagtctccaattaccagttaaggcctacaaaaaagattttccccaatgcctacaagtttttacacttggccctctccctaagtaaggaattccacccctaaacctcggtttt

SEQ ID NO: 15171 - DNA, 120 bp, Homo sapiens
tgtgaggaaaaaaatgacactccaattgtctgcagtcgcaccctttctttatgccgaattaggcctcattttaatctcctgccaacctttaattcctcctaagagtttggaagaggtttt

SEQ ID NO: 15172 - DNA, 129 bp, Homo sapiens
aacgtaattttaatagcttaagattttaagagaaatattaaggattaggaggggtagccataaggaaggaaaagaaaaagggttttaaaaccatgacgaagtttaatttaaagttttttaaaatgggat

SEQ ID NO: 15173 - DNA, 207 bp, Homo sapiens
tagcgattttcagcagagacgtagaaggcgccgggacccggaggaacccgaaaaaacagaactcaggcgaaagagagcttgcagtagcagttgccgttttcccaagagaacggttaagagaaccaagagctctttggtttgacccttacctcttgagagcaacaccctgcccaaaagagagagagtgcttagagtgttgtagagagt

SEQ ID NO: 15174 - DNA, 351 bp, Homo sapiens
ctcaccatagtctaatagaaaacaaccgaaaccaaataattcaagcactgcttattacaattttactgggtctctattttaccctcctacaagcctcaaagtacttcgagtctcccttcaacatttccgacggcatctacggctcaacattttttgtagccacaggcttccacgggcttcacgtcattattggctcaattttcctcactatcttcttcatacgccaactaaatatttcacttttacaaacacacatcactttgggcttcgaagccgcccgcctccatactggcattttatagaggggggtgcgactatttctgtatctctccacctacttgatgaggggcc

SEQ ID NO: 15175 - DNA, 142 bp, Homo sapiens
cgttcttccgggtcgtcgtttgccggcggcttcaggcattccaatggcaccggtagggcacctgctttttaccagaccactacctggtgggggtgccatgatgatttcattgtgggggtttgaggccttaacagatcctggg

SEQ ID NO: 15176 - DNA, 206 bp, Homo sapiens
acataatattttgaaggaaacttggctgtcgaacaatttttctctcctacctgctggttgaatgtccttgggggctgttcctaaatgatattgggttttttaatgtaaaccccctaatttgaaatatatatatgcggttttccccccataaagggataaaaatatattttggaacacccccggaataatagtgatatgggagtgga

SEQ ID NO: 15177 - DNA, 182 bp, Homo sapiens
aattggcctgggtttaggacctatgtattaaggccaccaattttttaaaaatatctgtgggttattatgttattatctccttgagggaaccaatcaagaattccttccaaggaaataaataaatggcccatgagatattaaaagggtgtttccaagggggtctttccaaatttcatagggtc

SEQ ID NO: 15178 - DNA, 166 bp, Homo sapiens
cacttactcttagggaaggcttccgttacttcctttgggaaaggtaaacgtggattaagttggtggtgtaggccttggcaggctttttggtggtctaaccttggaaccagaggtttttttagtcctttggggatttttcaccccctgatgcttttattggggaaac

SEQ ID NO: 15179 - DNA, 196 bp, Homo sapiens
agatgtggggaagggtattctagagatgccacctgccaactgtgattataacctgtcaacactacatggaggtcctgccctgattttcaagagaggttttcaccttcggaggtttccctgtaaaggccgcttcttttgaggtcctttggggagagggaggaggttttacttctcccggcccatgtaaggaggattt

SEQ ID NO: 15180 - DNA, 190 bp, Homo sapiens
attctcagtactggcgttttaccaatggatataaaaggatggcagggtaccccaaacccaatttttaagggggtttgggggggcctacccgggacaaattggggggcagcgtttccaccaggctaaaatataggaacggggcctaatttctgtgtattttttagagggaggggggacagcatccagcgta

SEQ ID NO: 15181 - DNA, 202 bp, Homo sapiens
ccgtcaagcaggagtagaaattggtatgcttagaagcagattctaaaagcagtttctcttcagaacatcttttttcataccacttgataagcatcttgaaacacccttgctgtagctgcagtaaaattggtgatgtcaaagagagaccatctttgaaacacatttttttccgtcccacaaatgggagccctataatttgtgt

SEQ ID NO: 15182 - DNA, 201 bp, Homo sapiens
ccagcgtttgacataccgacgtaggctttcctacaatacagcctctaacaaaactaggctgtcccggacccctggtaataggattgtttacccttatacccagaagggtggggaagaacccaaatctctcatttttggggtcccccagcagagatctcgcggggggttgcgtccttttagagctctaagcgttatttacag

SEQ ID NO: 15183 - DNA, 175 bp, Homo sapiens
tcatccctggttgagctggatctgtcccataacaagcttaaaaacataccaactgtcaatgaaaaccttgaaaacttttaccttgggggttaattaacttgaggaggtttaaaattaagggcctttttcaaggatcctgggggsccgttattcctcttcaagggaaaagaaattt

SEQ ID NO: 15184 - DNA, 151 bp, Homo sapiens
gaaggatgagaatagacacttttttaaaatgcaaagtgatctgaaaatcccaagcaggccccggttattttaaaagaagagcaggaaaatgttctaaccggtataggcaaccaaaaaggggggccccgaacaccgggacccccaatcttcc

SEQ ID NO: 15185 - DNA, 301 bp, Homo sapiens
ctggggaggggggcacagagacaccaacaggaagagaccagagagccaaaaggcaaaacagaccaaccacgtggtttttgcacgggccccttttctcctttttcggggcttagttttacccgccttgggttaataggaattttcggcagaagcgtgttttttcaaagttacgggctcggggaaccctttcgcgtcagaaagatctgagagtccattttaaaatcgcagattccaactaggggttggggctcacggcttgaattccagcaacttttggaggccaaggcaggaggataccttt

SEQ ID NO: 15186 - DNA, 304 bp, Homo sapiens
ttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccatttcttaggatcttcggagggaatggatgcccctctctgcatgatcttgttgaag

SEQ ID NO: 15187 - DNA, 170 bp, Homo sapiens
atacaattccaagttctcgcttcctcctttgggcatcacagcaagattccatctcaaaaaaaaaaaaaaagttcttttgtaattttcattccccaaatgggtacctttctgaaatatgatctatccaagtttttggatcgggcattatatttcaaaaattacagcttttt

SEQ ID NO: 15188 - DNA, 288 bp, Homo sapiens
atataatttaaaagaaagatatcagcgtattcaaaatagtaatttacaaaaaaatcaataaactctgattttaatgtggaatatgattaaggagatttatagatgttccatatgtagagagtgttgttgggaaaatgtatatagttgtctgagagaggtgagaaacaagttcaaatgatcacttttaaggcaataagacataatcttttgccatgcgcggttgctcacacctgtcatgcccagcactgttgagaagccgaggtgggttgatcacatgaggtcagcagt

SEQ ID NO: 15189 - DNA, 339 bp, Homo sapiens
gagggtgtcgcaatgttgccagtgtctgtctgcagattggctacccaactgttgcatcagtaccccattctatcatcaacgggtacaaacgagtcctggccttgtctgttgagacggattacagcttcccacttgctgaaaaggtcaaggccttcttggctgatccatctgcctttgtggctgctgcccctgtggctgctgtcactcacagctgctcctgctgctgctgcagccccagctaaggttgaagccataggaagagtcggaggagtcggacgaggatatatggatttggtctctttgactaatcaccaaaaacaacctgcttagccagattta

SEQ ID NO: 15190 - DNA, 258 bp, Homo sapiens
agatgtgtctacgtgcgctctgccattcaactcggacactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtgattgcctcacaataaaaagaaattttgcctgccaaaaaaaaaaaaaatataaaag

SEQ ID NO: 15191 - DNA, 135 bp, Homo sapiens
cctggctgaccataaggcataagggcatgcacctcaagcagtacctcgaggtggtcaacgcagaaatgcaggagtcgtattctataaaagggttgcgtgagttgtgtgagagtgcttgaagggggagaaaagcaa

SEQ ID NO: 15192 - DNA, 179 bp, Homo sapiens
gctaaacttggagtttgagtatagtaaattatgatccttaaatatttgagagtcaggatgagcagatctgctgtagacttttcagatgaaattgttcattctcgtaacctccatattttcaggatttttgaagcttttgaccttttcatgttgattattttaaattggtttaaataggt

SEQ ID NO: 15193 - DNA, 209 bp, Homo sapiens
catgtagctttcattgtagtgttcttatattgtatgtgtggagtggtgtgactgcttgggtaatgggttctttgggtaggttggggcatggggtgggtggcaattttaaatgttttttaacttttggggaatttaaagggtttgtttaattttgggagtaagtttttgttttttaaggttgtttgggtatgggatttgcgtcaaatgtt

SEQ ID NO: 15194 - DNA, 203 bp, Homo sapiens
  misc_feature 27: n = A,T,C or G
agcattcggccgagatgtctcgctccntggccttagctgtgctcgcgctactctctctttctggcctggaggctatccagcgtactccaaagattcaggtttactcacgtcatccaacagagaatggcaagtcaaatttccagaacttgctatgtgtcttggggttcggccatcccgccattgaaggtgacttcctgaaggat

SEQ ID NO: 15195 - DNA, 104 bp, Homo sapiens
  misc_feature 34: n = A,T,C or G
actttgttccagattgacagtcatctttcagttntttcctctgtcacttcaaaactccagcttgcccaataaggatttagacccagagtgactgatatatatat

SEQ ID NO: 15196 - DNA, 121 bp, Homo sapiens
caacattcagttgttcaggttcattcgtcaaagttcagttttagaactatttgtactcagtaacaaaaatcattttctttttttttttttttctttttgggaaaagcgttatttttttttt

SEQ ID NO: 15197 - DNA, 227 bp, Homo sapiens
aagctgacagcattcgggccgagatgtctcgctccgtggccttagctgtgctcgcgctactctctctttctggcctggaggctatccagcgtactccaaagattcaggtttactcacgtcatccagcagagaatggtaagtcaaatttcctgaattgctgtttgtctggggttcatccatcccacaatgtaaggtgagcttactctagggagtgagagagagatttd

SEQ ID NO: 15198 - DNA, 129 bp, Homo sapiens
acacaagtacaatctaaaagttatattggaaaacatggaaatattaaaattttacacttttactagctaaaacataatcacaaagctttacgttgtgaaaaaaattaacaataaatggcaatagttggg

SEQ ID NO: 15199 - DNA, 193 bp, Homo sapiens
  misc_feature 36: n = A,T,C or G
ttgtaaattttaagtcagtctctgtattagttaggnttaggtttaactacaagtgtcagaaaatccaaattaacagtgacttttgattttaactcaatatatttaggaatcaaataaaagcaaactggccgggtgtggtgcctcatttgtataatgccagcactttgggggggtgagggtgatgattgctggg

SEQ ID NO: 15200 - DNA, 168 bp, Homo sapiens
  misc_feature 34: n = A,T,C or G
tgaggagactggcaacctgaaaaaggctgtcaanctacagggctctaatgatgttgaacttgttgctgagggcaacagtaggttcacttacaccgttcttgtagatggctgctctaaaaagacaaatgaattgggaaagacaatcattgattacaaaacaataaggcc

SEQ ID NO: 15201 - DNA, 164 bp, Homo sapiens
caggaagagaatttagtacttgctaggctacatgaactactgaaaaattagattcgaccagttagtctagcctgcgaatctttactctgagctactttttaactgattctcaatgtatagtcacataggttgtagcttattatatgtccatggtgtcctgtctt

SEQ ID NO: 15202 - DNA, 177 bp, Homo sapiens
ggccattgtttttgtggtgggaggaggcaactacattgaatatcagaatcttgttgactacataaaggggagacagggcaaacacattttatatggctgcggtgagctttttattgctacacagttcataaaacagttgtaacaactgggacgaaaggtaacacagaggaacccttm

SEQ ID NO: 15203 - DNA, 297 bp, Homo sapiens
aaatgtagaacgtgttgccatgtgcggtggctcacgcctataatcccagcactttgggaggcgaggtggctggatcacctgaacgtcgggagtttgagaccagcctgaccggcatggggaaaccccatctctactaaaattacaaacttagctgggcgtggtggtgcatgcctgttagtcccagctgctcgggaggctgaggcaggagaatcacttgaccccaggaggcggaggttgcagtaagccgggatcgccccattgcactccagcctgggcaacaggagcaaaactccatct

SEQ ID NO: 15204 - DNA, 164 bp, Homo sapiens
ggaaggtgtttgaaaatcagcccttgtttgagtggagaatatttaacaattttgctatctaaactttctcatattacttctcaaggtgggaaattctatgtgaggatgtagaacttagttgttaaatttgtacccaaaaaaaaaaaaaaaaaaaaaaaaaaaaa

SEQ ID NO: 15205 - DNA, 186 bp, Homo sapiens
aataatatacaagaatatagtgtgcaaaatttaggggcaacatcatgaagaagtgtgatgaactgaaatcaattttacagctgtgattgctaaccagaaacaccacttcggaagtaacatgaaaaggcatgattgttagctaagagcaaaagcagctgtattgccaatgtatttgctctaatttta

SEQ ID NO: 15206 - DNA, 118 bp, Homo sapiens
ctgggtgatagagcaagattctgtctcaaaaaagcaataaaaataaaaaattctgtaaccccgccacatcaacaggcctgcagggggaaatcccttattcatgggcaattggatgggm

SEQ ID NO: 15207 - DNA, 228 bp, Homo sapiens
ctgaatgggcaaaagcttaaagcattccctttgaaaatcagcacaagacaaggatgccttctctcaccactcctattcaacatagtattggaagttgtggccagggcaatcaggcaagcaataaagggaaggaataaagtgtattcagataaggaggggggagtcaaaggtcaccatttgcaggtgacataatccattacttgggaaggccccgtgtcaacccaaagc

SEQ ID NO: 15208 - DNA, 212 bp, Homo sapiens
tagaaattctgttactctctgttattaatacataaatgaaaatacatttttttccatattggcatgtagctacaaatattaaaggaggagaaaaggtaatataattttaggtttaccaaatatggtggtgtattcaaataatacttgaccagcttatctaaaatgtacataattttgagggagcttatgaaatttgattttaataattatgt

SEQ ID NO: 15209 - DNA, 203 bp, Homo sapiens
ctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagca

SEQ ID NO: 15210 - DNA, 190 bp, Homo sapiens
cctaggtcgcggcgacatggccaaacgtaccaagaaagtcgggatcgtcggtaaatacgggacccgctatgggcctccctccggaaaatggtgaagaaaattgaaatagccagcacgccaagtacaatttctttttttgtggcaaaaccaagatgaagagacgagctttcgggatctcgcactctagttc

SEQ ID NO: 15211 - DNA, 223 bp, Homo sapiens
gagggagtgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactttggaggggttttagcccccagacaacaagtgtttttttaagagctaccccatggggagaaga

SEQ ID NO: 15212 - DNA, 300 bp, Homo sapiens
caaaggatctccttcatccctctccctgctgaaggaggaagaggaaacacaagaagaaacgctggtgcagagccccaatttttacttcatggatgtgaaatggccaggatgctataaaatcaccacggtctttagccatgcacaaacggtagttttgtgtgttggcttctccactgttctctgccagcctacaggaggaaagcaaggcttacagagggatgtttcttcaggaggaagcagcacttaagcactctgagtcaagatgagtgggaaaccatctcaataaacacattttggaga

SEQ ID NO: 15213 - DNA, 314 bp, Homo sapiens
cagtggctcatggcttaaatcctagcactttggggagggccaagacagggtggatcacctgaggttagggggttcgaaaaccagcctggccaccatggtgaatcccaatctctactaaaattccaaaaataagctgggcgtaatggcgaatgttgtaatccaagctactcgggagggctgaggcagagagactctctagaccccagagaggctgaggtcacagagagccgagcacacacgacactacactaaagcctgggcgacagagcgagtctctctctcaaaaaagcgcaaaagaaaagggatgataatag

SEQ ID NO: 15214 - DNA, 514 bp, Homo sapiens
tatgcagaagatagatacagccttttcagaagatttccactagtttttgtttccaaaaattcaagtttattgggagaaatctcaatttagccacccttttcacagtttgttgttggatataaccattttggggggatcttttcttggacttcctaccctattctgttgccatttttaccgggccaccctcaggaaaagggagggttgacccaggttttgttcttgagcttgtatacctccctgggggaactctctgagggaccctctctatttaaagttttatacccccagatttccccagataatagtaaaacacctacatgagaacacatctttactggaatatgaaatctcctattaacagctcttttttgggatataaagaggagctggagctttctcaaaaaaatcatgtatctggaggggtagatataatgagggatctccttaaaatgctgctttgagctcaaggtaaaaggacagcaggcacctaaaatatctgccatcatctcca

SEQ ID NO: 15215 - DNA, 292 bp, Homo sapiens
agcaaaggaggacaaatattccctttttaaaatagcactgtggtgtgggacttgaacttggattgaaccttaaatttttatattcctcaaataaaagagaggcagcgaccaaggatacctcaataatcaagatccctttggtttataaaattttggggcccaaatattttgggtaagaaaattacacaaaacacctttaaaccttgtattgggagaagggtaatgtgtaaccccaccacaggggaaaccctcacacttttaggggaaacacgctgggatatgagctctacaa

SEQ ID NO: 15216 - DNA, 160 bp, Homo sapiens
ctggacagttatactgtaacctcttaagttttatttaattaatatatcttttatgatttttttattttttaataaccattggaaatatattcaagggattatgatttctgtaaagctgttgaatgaagcctccagatttagggggacaatggcttcttta

SEQ ID NO: 15217 - DNA, 300 bp, Homo sapiens
acamttcytkggctttctgggaattttatctctgcttcacagtcttacaataacaacaataggttcaatacttgggcaactttaggccttcctggaattttaccagttatactcacacaccatttctcatatatatatctctctctctgtgggtaaaacaggggaaattctctcatattctctctctcgcgaataccacctgcactctcacatataaaaagagggggtgtaaagagtttttcccctctgggctctctagggtctaggagtattatgtagtattcacgatgattttccccc

SEQ ID NO: 15218 - DNA, 287 bp, Homo sapiens
  misc_feature 270: n = A,T,C or G
aggtccgtattttgggaagggacaaagttaacttttttaataacggttgtagttactttaaaccctaggatttaaattaacttgaatttccttagggcattatttttaggtctcttttgcttacacaaagagaggaggtattttatatttgcacaataagagtgtgtctctctatacacaaaaatgtgtctctctgtcacagctctctcctctcgcgcggggcgcgcgtatgatgacacacaatcgcagatctcccgacgggccccttgnataaggggaaacacacc

SEQ ID NO: 15219 - DNA, 307 bp, Homo sapiens
agacaccaagamctgctcaatgttaagatggcccttgacattttagattgccaccttacaggaaggctgcttgaaggcgaggagagcagggtttcttttcctttttccaactttttcttccttaacctctaaggaaactctatctctgagatcaatctcctctctgtgtgatataccactcaaaaaaggggcactttctttgattagagggcgtttagaactcgagatagacacaggtatacaagcgacttctctgcagtcatcgcgttgcaccgtagtataaatatttccaccaacctgtgaattt

SEQ ID NO: 15220 - DNA, 142 bp, Homo sapiens
ttttgaatattaaggaaggtcttggttattgatgatcaacccttttaattccagcacttttgggagcttaggcaagaggtttctttagcccaggagttttgagacagagccctcacgaaataaacagagactctcttatatc

SEQ ID NO: 15221 - DNA, 229 bp, Homo sapiens
ggggaaaaggtttaaggcaaatctggctttgtagtcccgatgttataagtgactttgtgatcaaactgtcaggcttggggtcttgttatagaatgcttggtatagaaagaccatgccatacataaatggctaacacacaagggaggggcttcactagtcacagtgcacaggtaggtcttttgcacagggtccctgcgttaaaaccccgacgagctgggtcctcagcttt

SEQ ID NO: 15222 - DNA, 223 bp, Homo sapiens
ttttcaacctttttttagatttatgcatgtggacatttttataatgtaattacaatcaccacaagggttagcttttttaattgcaaactataaattcaatgtcacacctattattgtaggtggcccttttcaagggcctaggtcccaggggaaaacattttttgtagaggtataggggggagtggggagggaagggggagggaataatttctctatttaaaag

SEQ ID NO: 15223 - DNA, 207 bp, Homo sapiens
ttcaatttaagtagataagccaattaagattatctcaaaataattgtgcctaaaattacaattttattaaaaatattaattttcaaagggcgcaattaagagttagagaaataaattagaaaacagacacataacagagactattaacacagtcataggctttttttttgaaaattttaataaatttgatatctctaagaagatgga

SEQ ID NO: 15224 - DNA, 210 bp, Homo sapiens
ctcacttgttctacaatgagtgccaaatctgctatcagcaaggaaatttttgcacctcttgatgaaaggatgctggggctgtccatgggtaagatggaggacaaagaaaaagaattcctttcttggcaactggagggtcaaggcgaaatatttaacttatatctgcctgtcagtgacaaacaggaaacccacacaggcgtccatcacaaa

SEQ ID NO: 15225 - DNA, 203 bp, Homo sapiens
ccctttacatttagattgtcacctacaggaagctgctggaaggcgaggagagcaggatttctctgccttttccaaacttcttttccttaaacctaagggaaactaatctggattcactccctctggttgatacccactcaaaaagggacacttctgattaagacggttgaaactagggatggacaggttatcaacgaatcttc

SEQ ID NO: 15226 - DNA, 207 bp, Homo sapiens
tatattgaaagttataaaattttttttaatgggcataattgtatatattaaaggcgtacaatgttatgttcctgaatataaaaagtgatatccacccctggaggattaaattaggctaattaatataatcctcaccccctcggcccccaaaaatgttgagaaaactcccttaatagataaagtattggccattagtctcacacatat

SEQ ID NO: 15227 - DNA, 215 bp, Homo sapiens
  misc_feature 187: n = A,T,C or G
actgttaaatatacctcttttttgggatattagttcagtacttttatacaaatctgagttttgttccacaattggtgaacaataaatttactggcaagaaacctttttggttttgttctaagaaaaattgttctaaggataacacatgcactagttgctgtggtctgtggcaaaattactgtaattncaaattggaaaaaaaaatgtttccagac

SEQ ID NO: 15228 - DNA, 207 bp, Homo sapiens
actttatctttccaagaatcagctgaaggaattgccagaaaaaatgcccaaaaactcttcaggagctgcgtgcccatgaggattagatccccaaggtgccgaaaaggttactttcaatggcctgaaccagatgattgtcacagaactgggcaccaatccgctgaagagctcaggatttgaaaatggggctttccaggaaatgaagaa

SEQ ID NO: 15229 - DNA, 209 bp, Homo sapiens
catttctccatgtggcagacagagcaaagccacaacgctttctctgctggattaaagacggcccacagaaccagaacttccacctatacttttaaaaattacataggtggcttgtcaaattcaattgattagtattgtaaaaggaaaaagaagttccttcttacagcttggattcaccggtccaaaacaaaaatgcagctgccattaaa

SEQ ID NO: 15230 - DNA, 218 bp, Homo sapiens
aaaaaggagttttaggcactggcacctagaagcctgcccacgattcctaaggaaggcttgcagaaaaccctggaacccttgggaagcctcccccaaattttccttggattggggcctaaattttttttggtgggaaaggcttgccctggggaataaaactttccttctgtgtgtgggctcaggaagttcttctgcagagatggcgttatcttctcccc

SEQ ID NO: 15231 - DNA, 144 bp, Homo sapiens
attgcgttttcgttcctggtttagacctcgcttcttctggcgcggcccgtgcggattcacatgtttttaaggtcatgcaggagttttacttcgggattcactttgggtatctctaccaaaggtctcttaggctgctgtcccagt

SEQ ID NO: 15232 - DNA, 122 bp, Homo sapiens
aaataaaattggataaccgtttcgtggaaagagactcagttcctaatttttctattgctctgggctatcatgtttgggtaattttttgtaattgggctgatttttaggaccccaaaataggg

SEQ ID NO: 15233 - DNA, 112 bp, Homo sapiens
attgctgaagcctgggaggtccaggctgtggtgagctgttattgaggggctgcactctagcctgggcgatggagccaaacccggtctcaaaccaaaagaacaaaaacgccaa

SEQ ID NO: 15234 - DNA, 230 bp, Homo sapiens
ttccaagagtactttgtcttcctgtcctgcatcgccatgatgtgtaacgaattctttgaaggcttcccagataagcagcttaggaagaaatgaaaactcctttaaatgtggttggggggtctgccagctggggccctccctgtcgccagtgggcactcttttttttccaccatggctccttaagacagagttttttttgttgggcaagttctttgaggtttcttggaggg

SEQ ID NO: 15235 - DNA, 280 bp, Homo sapiens
gagtggttgtgtggtcgcgtctcggaaaccggtagcgcttgcagcatggctgaccaactgacttaagagcagattgcagaattcaaagaaggtttttcactatttgacaaagatgggggatggacctataaccaccaaaggaattgggacctgtaattagatctttttggaaagaatccccacagagagggagagaaaaagggacatgggttaatttatgtgagagctcgtatagggatagggccaatttcgttcccccaagagttttaaaaagataaaa

SEQ ID NO: 15236 - DNA, 150 bp, Homo sapiens
tgcagccacaccaggacttttttgaagggtgttttttttcttttaaatgtaatacctccctcatcttttcttcttacacaattgtcttagaacaattacattataggtaaggaggacaaggggggaaaactctctacttttaggggggtt

SEQ ID NO: 15237 - DNA, 202 bp, Homo sapiens
ctgcagcaatggcttcaggaatttccttttctttctttacgatatttatgctggattcatttatcttgacatagtgagcaaccacagcagaagccctcaaatccattgggcacatattcaagggaatttccccctttttctctagcgcgcccccccgttggggtcttggggggaaccgtccccgcaaaagtagtgggggggg

SEQ ID NO: 15238 - DNA, 161 bp, Homo sapiens
acaaagcaaagtaatttaatacatgattaaaattgttattcatttattgggttgacaaggtttgtttctaattttaaaagaatatagagttaataggggcaaagatttctcacacactctttaaactttaagtttgtgggaaaacctcgagagtgacaggg

SEQ ID NO: 15239 - DNA, 341 bp, Homo sapiens
cgccatgggccgccgccccgcccgttgttaccggtattgtaagacaaggcggtacccaaagtttcgcttctgccgaggtttcccttatggccaagattcggaattttttgaactggggcgggaaaagggcaaaagtggatagagattccggttttctgggccaaaaggtgtcaagatgcattttcagccgtttcccctgcgcgcccgggggggctgccccgtttcgatgcccttgagacccccagtgacaaagtttgtggcgcgagtagggcgtttctctttcgcggtgggctcctcccccttgtcgcgtcgctaacccttatagacgggtgttgttctct

SEQ ID NO: 15240 - DNA, 212 bp, Homo sapiens
aagtgaaacatttgttgactgaaataggaaaagccaggaaaggtggctcaatgcctgtaatcctagcacttttggaggccgagcaagacgggttccttaagctaaaggggtttaaggccagcctggggaccaattgagaaattccttctctctcaaaaaagccaaaaaacataaacttgcgcggctgtgtcacaaacctatatatccaagcg

SEQ ID NO: 15241 - DNA, 124 bp, Homo sapiens
accaaaggtgacgtttggtgattaaggaaatcctgaggttttatctggaaacctatttcgggcaaccctaaaaatcaaccaagggctgagattaggggaatagaaaaagaacctggttaataaa

SEQ ID NO: 15242 - DNA, 241 bp, Homo sapiens
agattttggtagaaacttcttgggactaaacaagtttagagatgcatttaagaattattcacaaaatgtgtaattctaaattaaagcataaatatatttccaggtgcatttgatttctctgaggcatgatatagctggtcttacctagtgaatcaggattgtcctcaggtaaatgaaatcatgatacattattgcagtgaactataagtgccactactttgtaaggcatataattcctatg

SEQ ID NO: 15243 - DNA, 456 bp, Homo sapiens
tacccccaataggttactaagatattgcttagccgttaagttttttacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgcatttaaagcctagttacgcatttctaaacgcagacgaaaatgggaaggattaattgggag

SEQ ID NO: 15244 - DNA, 179 bp, Homo sapiens
cgctttgcccggccggacttcagggacattaccaaatggaacaaccgcgtagtgagcaacctgctctattaccagaccaactacctggtggtggctgccatgatgatttccattgtgggggttctgagcccttcaacatgatcctgggaggaaacggggtggtgctggagttcacaggg

SEQ ID NO: 15245 - DNA, 409 bp, Homo sapiens
ttgttgtagccggtgaattgagtcgtattctgtcacattatattttgaagaaaacttggctgtcgaaacagttttctctctgactgctgcttgaatgttcttggaggctgtttcttatgtatgggttttttttaatgtgatcccttcatttgaatattaatggctttttccattaaagaataaagagttggacaatgccgataaatgtatgaaggtagtatccacatcataaattcagagtgatggttagcagtaaatcaatattttgaagtgatcacagatgtctttcctcccacaaacttttttaaacaaaaaacaagacctctttttctttagatgggccacctatgcccaccacaacagagattttacatggaaaccgggctcagtgagaactgattcctgccaa

SEQ ID NO: 15246 - DNA, 338 bp, Homo sapiens
tttgctccttccaaagtacagtgtaagaacagactggaatagaagttaccccgatgacttggtttggaaggagttaaggcaccagtcatcctcttctaaagtgatttatgatgatgtgtggagtttaaaaactttaccccaccccaaagaacagccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagaaaca

SEQ ID NO: 15247 - DNA, 250 bp, Homo sapiens
tgaaggatgaagtaggcttggctttttctccataatgactgaaaggaaaaaaaaaaagagggaagatagaagaaaagcaggacagagacaactttccaccaatttttcccatctttgtgaaggtggtattatttcatgtccaggagataatccttttttaaagtatggagacttccaaaagttgaggtttagggagttcattacccacttttgagacttactataaagcaacaggttatcaagacagcat

SEQ ID NO: 15248 - DNA, 255 bp, Homo sapiens
  misc_feature 250: n = A,T,C or G
aatagatatagtaccgcaaggaaagatgagaaattataaccaagcataatatagcaaggactaacccctataccttctgcataatgaattaactagaaataactttgcaaggagagccaaagctaagacccccgaaaccagacgagctacctaagaacagctaaaagagcacacccgtctatttagcaaaatagtgggaagatttataggtagaggcgacaaacctaccgagcctggtgatagctcggtnttcac

SEQ ID NO: 15249 - DNA, 208 bp, Homo sapiens
agcactttccagggatactgagaagaaatccatcataccattacctcatcctgtgaggcctgaagacattgaataacccttggcagtagttcttaggcagatactttagatgctttatggacaatcattatttccattggatcgattgcaagagcgtgttcaggagaaaagtgaatcattttaggtgttgaaagactggaagaaaata

SEQ ID NO: 15250 - DNA, 202 bp, Homo sapiens
  misc_feature 38: n = A,T,C or G
ctcggtggtggccactgcgcagaccagacttcgctcgnactcgtgcgcctcgcttcgcttttcctccgcaaccatgtctgacaagcccgatatggctgcgatcgagacattcgataagtacgagactgaagaagacagatacgcaagagaaaaatccactgccttccaaagatacgattgtacaggagatgcaagcaggcga

SEQ ID NO: 15251 - DNA, 178 bp, Homo sapiens
  misc_feature 34: n = A,T,C or G
ttatgaagtttggggtatttttccccattgatantctttttatcaggtggaatctgaaggaaaaattttttgtttaaggattttagtatgcgtgttttagcatgatataaaagatggagggtagcccagaccgctttttaaaggatttggaggagtaactcgagaaatagtgggagcs

SEQ ID NO: 15252 - DNA, 197 bp, Homo sapiens
  misc_feature 32: n = A,T,C or G
atggtcagtaggacagaaggtaacattgatcnctcgctcattggtggaaatgcctccgctgaaggcccccagggcgacaggtaccgcaaagcacagtaatcactggtgtcgatattgttcatgaactatcacctgcagggaacaagtttcacaaaagaaggcctgacaagaagtacatcacacgttacatgacatcv

SEQ ID NO: 15253 - DNA, 115 bp, Homo sapiens
acatcttgatggcaacaaaatcagcagagttgatgcagctaggctgaaaggactcaaataatttgggctaggttgggatttagtttcaacaagcatctcttcctgttgacaatag

SEQ ID NO: 15254 - DNA, 303 bp, Homo sapiens
ccaaataacctaactaagaaacaaaacaagagatattacaactgacaccacagaaatacaaaagatcatttagggctactataacacctttatgaacataaactaggaaacttagaggagatgaataaattcctgggaaacatacaaccctcctaggttaaatcaggaggatttagataccctgaacagcccattaacaaggaggaaggtttaattgggagttccaaattcccgccaccaaaaaagtcccaggcccagagagttccagagaagttttttccagttttccagggagttggggcc

SEQ ID NO: 15255 - DNA, 131 bp, Homo sapiens
cctcgcttcgcttttcctccgccacctagtctgccaaacccgttataggctgggatcgggaaaaacggtaaaacgaaactggggggacagagacgccaaagaaaaatccccctccctcccgagagacaaag

SEQ ID NO: 15256 - DNA, 120 bp, Homo sapiens
tgattattttttatactgtatgtgccaaagctttactactgtggaaagacaactgttttaataaaagatttcacattcaaaaaaaagaagagaacgaaggaaaaaaaaccccttggggcc

SEQ ID NO: 15257 - DNA, 142 bp, Homo sapiens
aaacgtctggttacccacaaagggaagcccatcagactaacagcagattaatcagcagaaatcctataagccagaagagagtggaggccaacattcaacattctcaaagaatataattttcaccccaggtttttatatccgg

SEQ ID NO: 15258 - DNA, 205 bp, Homo sapiens
tattcttctgtccggatgtaccacagtttatttatccattcccctctgaagaacatcttgatggcttccaaggtttggcacttatgaataaagctgctataaacatccatgtgcaggcttctgtgtagacgtaaggttttaactccttttggtaaataccaaggggtatgattgttgggacttatggtaaaaatataaaaatata

SEQ ID NO: 15259 - DNA, 264 bp, Homo sapiens
tcatgaaatcagttataaatatggtgaattttttctggaccataggaatattatttcaaagaaatattacaacttaaccattaaattagtacttgaaggtgaggccttgtggggggactttttaaaaaaatgcctttttaaagcattaatggctaattgaagtattttatgactctctatttctcgggccaaaggggtgtctctgacaccctttctctcaccctctgtgttgtgtgtttctctctcaggacattcggtgtgtac

SEQ ID NO: 15260 - DNA, 269 bp, Homo sapiens
tccatctaccctgactcctccacagcttgattgcacattgatccaaccctcctaacaactagtcttccaaaatataaattggacttttcctgataccacattctccctcagtaggtcttcacttgacaaggtccttctagtattatcaggaaatccacccagcttcaccatttactgtgtacgtctgtagggctcggagaaaaattatgagaactctacacactatcctcacagtgtacaaacagagggaaatatccccgatgaagccc

SEQ ID NO: 15261 - DNA, 164 bp, Homo sapiens
caaagagaaaggtacctgggttcaactaaagcgccagctgctccacccagagaagcacacttttgtgagaaccaatggggaaggagcctgagctgcttggaccaattccctattaattcatggcattataggttttaaaaaaaggggtaaggggccccttggct

SEQ ID NO: 15262 - DNA, 224 bp, Homo sapiens
gaaccataagagcctatcttttgccatctgccgcctagcggaggaaccttggtcataaatacaataaagcaatgaaattaataacctaatccttcaattacaggagaaatgcaaaaaacctcattcccctagcagagaatgagagctaagctccagagaggatcgagaacgctctaagcctgtcacgggctcaatagggaggcctcttatgactacagactttg

SEQ ID NO: 15263 - DNA, 251 bp, Homo sapiens
caccttgttcgccagggtggtcttgatctcctgccctcggtggatctggccccccttgacctcccaaaggtcctggggattacagggcatgaagccaccacggcccagccgaggaatattttaataggtataatccagagtcgtgcttgcctcttattcctattgtccctctcctgtctctcctccattctaactccttaggtgaaaaactataatcagtctagttagtagcaatctagagtagataattt

SEQ ID NO: 15264 - DNA, 109 bp, Homo sapiens
caacatttttggggaaagtataggtaacaaacctattctaggaggggacacccgtctacgtttacacacccaggggagaaaaaccccctatttttatctttacaccaca

SEQ ID NO: 15265 - DNA, 142 bp, Homo sapiens
ttaagtcagaacagcagacttagctctgacaattctgattcgaatggcaatgttcaggaatcggaatcctgtcgtttaggctgtgacacagtttgttggcaaagtgaattttccccctaaaaaaacccgatttttttaaaaa

SEQ ID NO: 15266 - DNA, 212 bp, Homo sapiens
catgattaactgtagagttagaggtacattcatttgtggccatggttttttaatttttctaaaggcaccttgtatggacagtgaggtttcccactcggggaaggaattcctcttttggaaccccccccaaaatttttttttggcacggggctccaagtttgtaaagtttcaaatggaaaaaaggggaaaatatacgggtgtttaagggtccc

SEQ ID NO: 15267 - DNA, 142 bp, Homo sapiens
tccactcttcagttctgagaaaaaggactgctcttgcacttggggggccttcgggtttccgaggctcattgggacggcttggctcttatgaaagccccaaagggttccttaggacggcttggatacccctgtaaggtttaaa

SEQ ID NO: 15268 - DNA, 114 bp, Homo sapiens
ccccaatcacacaacaaagcacaaacattccagaaagtaccaataacacatggcaggtttcctgaaagatgaaaagtttgtgcgggggcaaagtatatacgcgacgccccgggw

SEQ ID NO: 15269 - DNA, 117 bp, Homo sapiens
caaggaagggggttgctcaaggcattgcattccattcctttactcctccccgctccccaaaattgaattttttttcacatcttccactttgggggaatgtcaactttgtagggaacc

SEQ ID NO: 15270 - DNA, 211 bp, Homo sapiens
cacacttcattttatgtattatttagtaattgcagtggtatgtgtttaatattttgctacctacacattaggcaaaaaaaaagatgtaaataatttgggagaaaaaggaggaggaccagtttaaaataaaactttctttaaggctccatttcaatgttttcaacatcatccctaaaggccagattttttcccgggggtggccaggggggtt

SEQ ID NO: 15271 - DNA, 198 bp, Homo sapiens
aaaattataaccaaggcataatataggaaggattaacccctataaccttttgcataatgaattaactaggaataattttgcaaggagaggcaaatgtaagaacccccaaaccaggagggggtaaccccggacagggtaaaaggggcacccttttatttgggaaaattaggggggagggtttatagggagagggggaca

SEQ ID NO: 15272 - DNA, 282 bp, Homo sapiens
  misc_feature 17, 18: n = A,T,C or G
tactgcttttgaggacnncttcattgatttcaacactctccatggaactcattcatgaggttctagcgagggatgattttatcagcatttaaaacaggacgttagtgtcttcctcagtcccatctctgtcattcattgaacctgggcaaattccatgccttcccaggtgtttcctactcatcaaacaaagcattagggtaaacggattaggccttgggtaagagttcaaaatttatatgtaaagacaaacatgattgttatacagaaacagtttttactcct

SEQ ID NO: 15273 - DNA, 250 bp, Homo sapiens
  misc_feature 15, 16, 17: n = A,T,C or G
tcatcttgttttatnnnttgctataggagtgatgtcctttggataaaatatagtatgtcagtctgtttgcctctctacagagtgatctgacttgagtactgacaagcacactacatgacctatccaatttaaaatgtttggtttctaaaagattaagaaatgagccaaaaatcagatgaaagtaaacaaaagatttgcatgacctgaatctgtaaatctctgagggctatacacaaaattttatttttct

SEQ ID NO: 15274 - DNA, 233 bp, Homo sapiens
  misc_feature 18, 19: n = A,T,C or G
aaacgacgtcataatcannctcaatggacagtccgtggtctccgccaatgatgtcagcgacgtcattaaaagggaaagcaccctgaacatggtggtccgcagggtaatgaaggtctcatgatcacagtgattcccgaaggaaattgacccataggcaggggcatgagcttgacttcatgtttccctcaaaggctatcccgtggatgacggtagagggcttttggcttcttgaa

SEQ ID NO: 15275 - DNA, 222 bp, Homo sapiens
  misc_feature 16, 17, 18: n = A,T,C or G
agtggcttcgtcttcnnncttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagawkatgmcc

SEQ ID NO: 15276 - DNA, 213 bp, Homo sapiens
  misc_feature 15, 16: n = A,T,C or G
aacagttaactagcnntcctaaaagcatttcatattgatttttttcccatacaggcacatgatggctccgctacttacttgagattcattattgtatcagcctttgatcattttgcatctgtgcatagcgtttctgcaggaggtacagtagtctcaaatctttcctcataatgataacaaaatgctcttgcatgattttttaacaatatattt

SEQ ID NO: 15277 - DNA, 143 bp, Homo sapiens
  misc_feature 16, 17: n = A,T,C or G
aataaagtataggcanntaaattgaaacctggcgcaatagatatagtaccgcaaggaaagatgaaaattataaccaagcataatatagcaaggactaacccctataccttctgcaaaaaaaaaaaaaaaaaaaaaaaaaaaaa

SEQ ID NO: 15278 - DNA, 284 bp, Homo sapiens
  misc_feature 16, 17: n = A,T,C or G
gatgaaagatggcacnnattctagtatttgagaagtataataaggatggagctacgctctttgcgaccgtaggctacatgacagtctataattactatgtgtacccagacaaaaccggccacgtgtaagtcagatgctgattttgactccatttcaaggtcatggccatggtgctcaacttcttgaaacagttcatagatactacactgagttgcctacagtgttgatattacagcgggagatccatgcaaaagctatgtgtaattacgagactttgtgcttgt

SEQ ID NO: 15279 - DNA, 51 bp, Homo sapiens
cttctgttactgatatgtaagtgtggcaatgtgactgaagctgatgggctc

SEQ ID NO: 15280 - DNA, 258 bp, Homo sapiens
  misc_feature 17, 18: n = A,T,C or G
aaaaagatccaaaattnntttgtaactatttaaaggtcagcagctaatgataatcagaactaataatagatgcttacttatgcgccaggtattagtctaagccattgatgtgttagttaatacctctcaacaagtaagtgaggtagaggcttttattattttatagatgaggaagctgaagctaggaaaggtgactgaggcccacagaccttgtagtaagtggtagaacaggctaggcagacaggtacgtaggtaggt

SEQ ID NO: 15281 - DNA, 154 bp, Homo sapiens
tgcagaaaaaacattaaccctcttgttggcagtcaggattgaaggcaggaaaattattgctttcacttcttggttgctttctttgttgcggaggcggttcttacttttttcctttcgtgttctctcttctccctctattggggttggggcgctt

SEQ ID NO: 15282 - DNA, 210 bp, Homo sapiens
tactttccaaatcagttactgttcaggggatccttctgtctctcacggggttgaaacatgtctttagtttctcatgttaacacggaggccagagccaccatggacctgttgggtgcttcccttaggaagggtgagggatatgagaaatttccaagagaggtctatatctctaatgatctctttataactctcttttaaaagagttcccga

SEQ ID NO: 15283 - DNA, 129 bp, Homo sapiens
aaaagtcctaatagtagaagaaccctccataaacctggagtgactatatggatgcccccaccctaccacacattcggaggacccgtatacataaaatctagttaaaaaagggagggatcggaccccctt

SEQ ID NO: 15284 - DNA, 200 bp, Homo sapiens
taaaccatgtattcccttatcttttactttttttctgtgacatttatgtctcaaggaatttgcattacaatggggggttgttctaggacggtattgggcttcttcggtaatagaatatttcatatactataattgtaaatatttgggtacacaaagtttataaactctaggggatatataaacagagatctgatgtcctc

SEQ ID NO: 15285 - DNA, 236 bp, Homo sapiens
tgttgaaggatctttgatagttgagaaaattatgcaaaggtcctcagaaggtggttattatgctattgctggagattttgtgaatatggtggaaaaagggatcattgacccaacaaaggttgtgaggactctctttatttgatgctgctggtgtgtgcctcttctgttaactacagcagagagtgtgtagtcacagaaattcctccaagaagagaaggcccccctgagtgaggtga

SEQ ID NO: 15286 - DNA, 171 bp, Homo sapiens
tcaactctgtaaatccacagcaaatggtcctgataagaatgaaccggaagtagaagcagagcagcccctctgcaggtcttagagccagtttaaagaaggaaaaaatgaaccactttctctgccttagtttaccaaaaggcttaccgaggcaaatcagagaatggcaaaaat

SEQ ID NO: 15287 - DNA, 112 bp, Homo sapiens
tgcgttccggtgtgggtgtgggtgtgccttcgacggcgtctcggtgccaatgtcgagggtctttcttcctagctaaccggagcccactaccgaggagggacaacccagttta

SEQ ID NO: 15288 - DNA, 200 bp, Homo sapiens
aatcagctgaaggaatttccagaaaaaatgcccaaaactcttcaggggctgcgtgcccattagaattagatcaccaaagtgcgaaaagttactttaaatggacttaaccaaattatttttatggaacttggaaccaaattccgttaagggctaagggatttaaaatggggttttccagggaattaagaggctctcctaca

SEQ ID NO: 15289 - DNA, 211 bp, Homo sapiens
aagagctaatgatgctatagcttctgcttgtctctatattgcctgtagacaagaaggggttcctaggacatttaaagaaatatgtgccgtatcacggatttctaagataggtatttggtcggtgttttaaacttattttgaaagcgctaggaaccagttttggatttgtttacacacttggggcttcatatccccggttcctttcccccct

SEQ ID NO: 15290 - DNA, 251 bp, Homo sapiens
gcctgtaatcccagcactttgggaggccaaggcgggcagatcacgaggtcaggagattgagaacatcctggctaacacagtgaaaccccatctctgctaaaaatacaaagaattagctgggcgtggtggcggacgcctgttggtctcagttactcgggaggctgaggcaggagaatggtgtaaaccccggaggcagaacttgcggtggggcaagaattgtgccactgcactccagcctggggtgacaaagc

SEQ ID NO: 15291 - DNA, 265 bp, Homo sapiens
cttatcaagacaaaggtgtccttcataatgaagttaaagtgagtatactgtggagaggacttccaaatgtggttacctcagctatatcactgcccaacatcagaaaaccttacgggtattattactattccctttctaaagattaatactataaacacataatgtgtccccgtgagagcccaaagagggaaatttttcttcttttttctgggacaggcccatctccaagggtcggggcacaacctccccaggagccttatggggc

SEQ ID NO: 15292 - DNA, 200 bp, Homo sapiens
ccttatgttttttttctacataaaaaacagcacaggatttatctttcagagctaataaatatggtcaaataaccacaaccccatttaagggaaaatattacttggcagcaaattattaattcaggccacattttgttacaatttgttgtgaggttagagagaggtcacatttttatatatgtttcccccgggagcggggt

SEQ ID NO: 15293 - DNA, 264 bp, Homo sapiens
ataccacttttatgcacagagcaagtaaactccatctttaccatggccaactgtagcattagagttcagtgttttctatatcacagatagaggaggtaacagaacttcatccatttcatcttcatatatggtagggcgaggtgtctcagaggcagggtgtgagaaagacagggtctggcatgcatgtgtattgaaatgggctcgtcgaaaggggagaggattttcctttatagtagcaggcccccaggtagcatggggattcca

SEQ ID NO: 15294 - DNA, 256 bp, Homo sapiens
cccacccatgggagagctgctctgtattttcagcagaatagggtgtgttagtgtcagagcccttataaggaacaggccagtaacccaccccccttccaagtgaattaaactcaatcgcgtgtgacacacagtattttcccccccacccccagtttgggcttctataaattagagccccccaataatggggggggagagatctaaagataagtggatgagaaggtgttctcgaagaaactctctatgcggggtaaag

SEQ ID NO: 15295 - DNA, 211 bp, Homo sapiens
agtaatgagtggcaggtgatgaaccttaagaattgtatttcttttttatttccacattacaaatttttggaattaaagagtcttttttttaggaaacccaaattaaaggaaaatttccccttttggggaaccttaagtttctcaaagggtttggggcaatatctaatttcagggaaaaagggagaaaaggaaaattcaaaaaccaattttg

SEQ ID NO: 15296 - DNA, 110 bp, Homo sapiens
accaacatcgagcagggttttaggtcttttcgtggtcagtaaattccgggaaattcaacaggagcttttcagtggaagggattaagggcaacttaattggtggaaacaaa

SEQ ID NO: 15297 - DNA, 156 bp, Homo sapiens
tactttccaatctcagtcactctaggactctgcactgaatggctgacctgacccgatgtccattcatcccaccctcttacagttcgggcttttctcccctctttttttaagggacctgaactggggagggttcaaaataaaaatttctggggttct

SEQ ID NO: 15298 - DNA, 258 bp, Homo sapiens
tattaaatgctcaagttaactttggtagaggctgttttagggaccttataggtaagaaatgttaatacagggattacttaggggtattacttttacaatagggaaattttcccacccacttcttcttgggctattaaaccttcaacttacaagaaacccttttttcccctttcttcacaaacacaaggtttttttccctctctgagatatccctttttatttgggaaaaaagggataaatgggtttttaaaatttaaa

SEQ ID NO: 15299 - DNA, 211 bp, Homo sapiens
catatgtgagtcgccaaagatgttactgctcttggtgggcagtgttctatatcggttatgtaactttcaattaaaggaattattctaaaatgcctctggggaacagtaaaaaataaaacaacaaggtgtctaaaatgccaccccttttatggtgaatggtaccatataaatgggggctcccaccccatgtggtgtggtgttatttacagag

SEQ ID NO: 15300 - DNA, 202 bp, Homo sapiens
actgacctgcctgtagccccagtgacagctaggatgtgcattcttcagccatcaagagacttagtaaaggttgttccttaaggcaggacaggaggctaaggtctgacattctggttcggattaacacctgttaaggggtcggggtcctgtcggttgggctgggcagctttttgaaagggaatttgcctttaccacggcaggg

SEQ ID NO: 15301 - DNA, 201 bp, Homo sapiens
accaaaaataataaaggggacaaatattgcttttctaaagacttcttttggaattgccaggacagcagggatttttcctacacaaaattctctaactctgagagacatttgtcaaaaagagaaggtctcaaagatttggaaataaaagggatgaaatatttagaggcagactctcgcgtatttcccccctcccaagacatc

SEQ ID NO: 15302 - DNA, 247 bp, Homo sapiens
acttgactactttgcgcaatggggacataggtgcattccgaggtcaatatttctttggtgcttagggcccttcagagccccacatttctcagagtcgggagagattatctctgagggtttggggggttttcccctcccccccatgggtatctcttttttatcctagggaagatctgtgagaggaaaactcttttctttatataggggattcccagcacagggcgttttccccaactaaaatatagga

SEQ ID NO: 15303 - DNA, 119 bp, Homo sapiens
tgacgaaagattacaaatgttagagttctgtcacgcttgcaagaacgtttttaattagttcgttgcactctaatagagatggaagcgggtgtgtsctctctcgtgagcttctgggcgcg

SEQ ID NO: 15304 - DNA, 232 bp, Homo sapiens
acagctttctaaggcaatgtgatgtctttgcttcttaattctctttcctcttgcgtttgtaggttttgaaggggtggagggcccaggggacctccaggaaagatcttacccatgtgtgtggaggaaattatgtgtatatgggagccggggaagctcatatcccctctttggctctgtacctcttcaaactctagtgtttcccgaccccaggggggagagttgtgtgcacacg

SEQ ID NO: 15305 - DNA, 217 bp, Homo sapiens
cttcttttatatgttaagtttaggttgcagtactcataatttttatttctgccattatgttataatggaggtgtttgccatgcctttctttaacccaaggaaaacggtgctgttttctctgtggatgtgtcacactctttagacacaggtttggctcacttttcccatcataggtggcaatatagagtcacacatcacatggtgtctcacatctaca

SEQ ID NO: 15306 - DNA, 210 bp, Homo sapiens
tccctcctccaaacacacacagaattggcctggtttctttcaagtttaaaaaaagccccccttctcaatgcacaaggttcaattccctccatgctgttcggcattcgacatatacaggttgtgtacgtgagggtttattgtgtgtacttttgcacaggtatatctccttctgtctggagggccctctttaaaccctcttgggaataactc

SEQ ID NO: 15307 - DNA, 181 bp, Homo sapiens
gagttaaatggtatctgtggggggcttcccaatgtggttcctcacttttacctgccccactccagaaacctggcggctttgattccttagccttttcttaggtccatacttttacttggtgtgcctggtgggccgccagggccattccttctcgttctgggcgggccttttcccagtctgg

SEQ ID NO: 15308 - DNA, 201 bp, Homo sapiens
ggggggcttgctgggaagagaggcgaacagggtcacctttcaagggacccagaagtaggggttttggcctaggtaacgggggcaagaggatgttggttcggaggattcttccccgggacttcttccggaaaaggggcggttgtgccgttgtttgaattccaaggaccttggcgtacatgcggtaccaatccaccacggttt

SEQ ID NO: 15309 - DNA, 201 bp, Homo sapiens
ttaaataaatgaagtgcagtggcagtatcatagctgaatcccaaacacaaagtttaaagatgctgacatgaacttagtggggacaggttttgcaagcacagctttttgtccttgaattgtcgctgccagcttgtgtgatccccccccagatcttaggttccattttagagtactgggttttggtacattcatctcttttga

SEQ ID NO: 15310 - DNA, 203 bp, Homo sapiens
ttgaaagtattttcagttaagcctaagctgattaatcacacaatacatacttttcctgcattttctttcagtgacatttgagaattgggtgacattttaaaatgtgttttataccatttagcttttgcaaacaaggtcttaaggtttcgaggaaaagttgatgattggacacagggattgtaagtgcttcatgaatatgctat

SEQ ID NO: 15311 - DNA, 153 bp, Homo sapiens
cagcaccctcctgaaaactgcagcttccttctcaccttgcagaataatcctagaaaactcacaaaatgtgtgatgcttttgtaggtacctggaaacttgtcttcagtgaaaactttgatgattatctgaaaggaggtaggggttggctttggc

SEQ ID NO: 15312 - DNA, 195 bp, Homo sapiens
agccagtatctattgcataacatgaaaatcgcatttttacaaaatgtattgttctgaatgtatagcttaccatataattgaatataagcggggttttgggtgaattgccttaaagggggcaaaagggatttggtccacattgagaggtatgggggttttctggaggggggagaatggggcgcttttggggccatt

SEQ ID NO: 15313 - DNA, 200 bp, Homo sapiens
aattgatttttcttatcttgatttctttcattagaaactatccctaaatgtaaagatcttttgccatcaaatttggcttatttgttctgatttatgaggggttgaaagaaaggattcacctaaaagggtccctttccagttttattaatgtatttcagggttctggaattaccaataatttgtcccacattggacggaaa

SEQ ID NO: 15314 - DNA, 296 bp, Homo sapiens
aagttgggggaagagacctttaaaatcttgtggtgttgaacaatgttatatgaagtagaaaaaataaaatacttcccagttgtgtgttttgttttacagcaccatgtcctgtattacttgatattttaacaaggatcagggactctctaacaaatgtacagkttttgctaagggaaatattaaggaatttttatcagtgtaaatatttgttgcaaataatttcatatggggtttagagacacaccgtagttgatatatactcttgtgaaagtaggggaatcacatttatatatagt

SEQ ID NO: 15315 - DNA, 258 bp, Homo sapiens
tacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgg

SEQ ID NO: 15316 - DNA, 660 bp, Homo sapiens
attgcagaagcaaaactgacctcagttcctaaaggcttacctccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagaatgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataaggattcaaaaatccctacatttggaatacttgaactctattaataatggtagtattatatatacaagcaaatatctattctcaagtggtaaggtccactggccttatttttatgaacaaggaaatttcaaccggaatttttggccaaacctattggatccat

SEQ ID NO: 15317 - DNA, 238 bp, Homo sapiens
ggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagacgatacttgctgctgagctggctactgtatacagtgtacaatgtgtatttcttcaaccatatattttaaaaagacgtacatagaa

SEQ ID NO: 15318 - DNA, 331 bp, Homo sapiens
actttggagtaaaaaaaaggaggaactttaactcatgattttgctaatgtcttttcagctccagccaagctatctcactaaacctcttagaccctcagacctacagaatagtcttttagaggggacatgagggtttaaaaaatactaagatgaaagcattgactgggcatcatggctcatgcttgtaatcccagcacttgggaggccaaggcgggtggatcaattgaggttaggagttcgagactagcctggtcaagtgactaggttaggagttcaagactagcctggtcaagtgaaaccccatctcaactggtgaaaccccatctcaacc

SEQ ID NO: 15319 - DNA, 282 bp, Homo sapiens
actttgggaggccgaggtcaggagttagagaccattctgaccaatatgatcaaaccccgtctctactaaaaatacagaaattagcggggtgtggtggcatgctcctgtaatcctagctattcaggaggcttacgcaggagactttctttaatataggaggcagacgttgcagttagccgaggtcacggcattcacttcagcctgtggcaacaagagcgaaacttcgtttcaaaaaaaaaaaattccttggattttgtgtgaggggggggacatattttgagt

SEQ ID NO: 15320 - DNA, 315 bp, Homo sapiens
gacagttttgtcatggctctgttgattgcaactccttgtatagcttgtattttgatttagtttatattctgcttattatgtatactgtgttcttatatatgrgraagcacaaatgcgaaagaggtcatgtcttctcaaaatctagcaaaggaagtagtctgcattggtgtgcaatacagtattttgcttaatgaaagcctcagttctgtaatgttgatatgagtagttaaaagacagtggggccccactcatcgtgtttatctcgtgctcaaagatatctcgggaataaagggggacacacaatgtacacacact

SEQ ID NO: 15321 - DNA, 145 bp, Homo sapiens
attaactagaaataactttgcaaggagagccaaagctaagacccccgaaaccagacgagctacctaagaacagctaaaagagcacaaccgtctatgtagcaaaatagttggaagatttataggtagaggcggcaaacctacccag

SEQ ID NO: 15322 - DNA, 171 bp, Homo sapiens
acagaagtgccctggaagaaggcctgctctaaattatccagtgtatggagaaacgacacaggttaggagacgtcgctttgaacgtgctataggacctctctcaaacacacacccatcagaattcaatattcacctgccagactggcttatcaaggcacaggtgtcctccat

SEQ ID NO: 15323 - DNA, 184 bp, Homo sapiens
aggcggagttgagggaaccgcagataaggttttttctctttgaaaggtagagattaatacaactacttaaaaaatatagtcaatagggtactaaggtattgcttagcgttaaggttttaacggaattttaataggttaagattttaagagagaatatatgagagttagagggagatagcccctt

SEQ ID NO: 15324 - DNA, 260 bp, Homo sapiens
aagaaggcctgctctaaattatccagtgtatggagaaacgacacaagttaggagacgtcgctttgaacgtgctatgggacctttttaaacacacaccattaggatttaatgttaaacttccaaacttggtttttaagaaaaaggggtcccctcataatgagagggaaaagggggtgtactcttgggggaggggttttccaaaattgtggttccccaaattttatttttctcccaaaaataaaaaacccctcggggttttt

SEQ ID NO: 15325 - DNA, 268 bp, Homo sapiens
aggcggagtttgagggaaccgcagataaggttttttctctttgaaaggtagagattaatacaactactttaaaaatatgggccatagggtacctaggtaattcctagcggttagtttttaacgtatattttatatatgctctaaaggttttttagaggagaaatatctgagagctctgagagagtgggcccagtagggaaagggaaagatataaaggagtttctatacacacgtcgcagagtttagatagaagacatactttcatagg

SEQ ID NO: 15326 - DNA, 241 bp, Homo sapiens
ccttctcaaacacacaccatcagaattcaatattcacctccagacttgcttatcaagacaaaggtgttccttattatggaggtaaagttgaggatccttttgagagagactttccaatttgtgtgtacacccaactatttatactttcccccacaaaaagagaaacccctccgcgctcatatattacacatatcctctttctataagagcacatacacatatacacattagtagtgtccca

SEQ ID NO: 15327 - DNA, 366 bp, Homo sapiens
ctgaaaatatacacacagcctctcacacacaagcacaattcaattaggacctgaggttaaggaacttacttaaaaccacaaaattaccttggaatttggccaccctctctccgagattactctccctggtaaataatgagaataagggcgcggaatcagagaggtctcttgagaaccacactagagcacagagagcacacaccaaactctcgcgcacactctaagcgcggttttgaggggagagtataaagctctaaatccccacaccagagctgctagagtgatctcatcggggacacacctcatcacactaatgagggaatgagagaaatgatgagatatccgatggggtgcgcgcgcgtcccc

SEQ ID NO: 15328 - DNA, 250 bp, Homo sapiens
aatctgtttctcctaacagatagtaaccctgccatggatatactacttcaaccatggtataaaaggtatgtggtaatatacaatttcgccccgggtttcttaattgctctttacacattctctatctccgggggttgccccgcagggctcccagagggggaggggtttggggcgcgggcgcagaccccgcggggggcaccagggattgggggcccttgcagcggataatcaccatcatggtagcgcaccc

SEQ ID NO: 15329 - DNA, 211 bp, Homo sapiens
agcagctttctccagtgatcaagagttcaccttctttttcaacttcaaagtggcacaaacactgtgctttccatcttagagatctgattgttctgtcagaatttatatttacaggttcaaagcaataaatgggggaataggaagtttcctcggttagcccccaactgggcaggaattaatatactcggggtaccccccctctttttgttat

SEQ ID NO: 15330 - DNA, 199 bp, Homo sapiens
taaatataagactggctgaatctgtgtatttgtcaagagaggtggcagcattcagcagtatatttataaacaggcacctgtacagaggtgaccctggaggagggcctgctctaaattatacaggtgtatggggagacggccacagggttagggggacgggtgctttaaacgtgctattgggcccttctcaaacacacac

SEQ ID NO: 15331 - DNA, 238 bp, Homo sapiens
tcataagctccattctaaaactggtcactgttagctgaaattgctttggttccccaaatgccttggactgcagacgcacccgcaggccctgaggtaggcttcatagagttctaggacttccgtgtgcgttgccaccagatcctgcccagcaatggcctttcccttctaagggcactaggttcagccaaaagcgacctattctttaggtccggttttacggacaagaggtcttaggtgt

SEQ ID NO: 15332 - DNA, 241 bp, Homo sapiens
taattacatctcagctttgagggctcctgtggcaaattcccggattaaaagggttccctggttgtgaaaatacatgagataaatcatgaaggccactatcatcctccttctgcttgcacaagtttcctgggctggaccgtttcaacagagaggcttatttgactttatgctagaaggtgaggcttctgggataggcccagaagttcctgatgacccgtacttcgagccctccctaggccca

SEQ ID NO: 15333 - DNA, 253 bp, Homo sapiens
acaaaaattaactggttgtggttggcacatgcctgtagtcccagctacttgggagactgaggtgggaagacacctaagcctgggaggccgaggctgcagtgagccatgattgtgcaactgcattccagcctgagtgcacacactgaggcctgggggacaaaatgaggactttttgttcaaggaaaaaaaaggccaattgaaaattgaggaggtttgaagtttacaggtgttcccacttgtgtgatacatagac

SEQ ID NO: 15334 - DNA, 232 bp, Homo sapiens
attgaggcagccagcgcaggggcttctgctgagggggcaggcggactttgaaggaaaccgcagataagtttttttctctttgacagatagagattaatacaactacttaaaacatatagtcaataggttactaagatattgcttagcgttaagtttttgacgtaattttcatagcttaagcttttcagagaaaatcgtgaggcttagcagggtagccttagggaggcaaagw

SEQ ID NO: 15335 - DNA, 210 bp, Homo sapiens
atgttaacttattcataacttcattatttactgtgttattacctgtagagatataacatacatattattggtgtaggtgacagagcttatgatcctaagcacttccatattagggtcagtaggattcatgattgatgatcattatgtcccactctacataagatggggggattctccagggcggtcaattaggtggatactcaggtcctr

SEQ ID NO: 15336 - DNA, 203 bp, Homo sapiens
ataatgtagaagaacttttagggtttttggaactgtacaattctgcagctacagattctgagaagctgtagataaactttacagggatatgggaaaaaaaccctgaatttatctaagggaagggggacctgaaccctgaaccggttggaggccaacctcagggggaaggtgatagtgtttttcccaagaaacaccttgggggt

SEQ ID NO: 15337 - DNA, 139 bp, Homo sapiens
gagggtggaagcagagcgctgcatgcccagccagtcccacagcataacagggtctcttggcagctgtattctggagtctggatgttgctctcttaaaggacctttaataaaattttgttacaaagacaaaagaaaaaaa

SEQ ID NO: 15338 - DNA, 222 bp, Homo sapiens
aggccagagacaaggcagacaaaggttcatttgtaaaggaagctccttcccagcacctcctctcttctccttttgcccaaactcacccagtgagtgtgagcatttaagaagcatcctctgccaagaccaaaaggaaaggaggaaaagggccaaaagcctaaatgaaactggatggtacttgttttcaccattgggctaaccttgctgctagggggtcaaggc

SEQ ID NO: 15339 - DNA, 226 bp, Homo sapiens
gctgacagatcggcgagatgtctcgctccgtggcctagctgtgctcgcgctactctctctttctggcctggaggctatccagcgtactccaaagattcaagtttactcacgtcatccagcagagaatggaaagtcaaattcctgaattctatgtgtctgggtttcaaccatcccacatatgaagtggacttactggagatggagagagaattgaaaaagtggagca

SEQ ID NO: 15340 - DNA, 293 bp, Homo sapiens
ggctgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactagg

SEQ ID NO: 15341 - DNA, 304 bp, Homo sapiens
aggtggcagcattcagcagtatatttataaacaggaacctgtacagaagtgccctggaagaagggctgctctaaattatccagtcgtattggaggaaacgacacaaggttagggggacgtcggctttgaacgtggctatagggaccttctcaaacacacaccatcagagttcaatatttcacctcgccagactgggcttatcaagacatagggtgtgctgcatagtgaagtcacagtgagtatactgtggagaggacttgcacatgtaggtgacctcagctatatcactgcccaacatcagaga

SEQ ID NO: 15342 - DNA, 244 bp, Homo sapiens
gtaagtactataaactgatgttctggtagtaaaaatatattaacgaactaagtttttaaaaataagtgtgcattttataaaacaaaattcaaagtactgaattgataccagaattggatcaagatctctaaactaaacatagccataattctataaaatgagaaggtgataatcttagagaaatctttgttgctttgaggcactcatatcattttcacaaatatacctctaaaaatactatata

SEQ ID NO: 15343 - DNA, 188 bp, Homo sapiens
tgtcagattacttcccactctactctggctgagtttatgctacatcgagtcctatcaaggaatgaaactccatcattctgaaatgtctgagcacagcccgagggtctccttgttttgtaacctccatgggggatcacctgcaagggacttccccacacttccagaccacttttggacgtttttattaw

SEQ ID NO: 15344 - DNA, 153 bp, Homo sapiens
aaacatagttttggtggcattaagtctggaaatgtattggaaaatgacaataagatggtttctgagtgctatgggaactcgcaagtgtttgggcttggggtgcagtgacttcaagctttgtaaggcccaggcattttttgggagggcttgagg

SEQ ID NO: 15345 - DNA, 152 bp, Homo sapiens
gcaaatttccagtttaagtaattgcctacaataacaaggaattttgcctgccattttcagaatcatctcttgaagctttcctgttgaatggttaactgaggcttactaggagatattcttatttcgactaaaatgtaaaatctttggggaaa

SEQ ID NO: 15346 - DNA, 181 bp, Homo sapiens
ttaaaacaactactcttgcacccaaagtaactacaacaaaaaagacaattactaccactgagattatgaacaaacctgaagraacagctaaaccaaaagacaaagctactaattctaaagcgacaactcctaaacctcaaaagccaaccaaagcacccaaaaaacccacttctaccaaaag

SEQ ID NO: 15347 - DNA, 206 bp, Homo sapiens
actgtcaatgagaaccttgagaactattacctggaggtcaatcaacttgagaagtttgacataaagagcttctgcaagatcctggggccattatcctacttcaagatcaagcatttgcgtttggatggcaatcgcatctcagagaccagtcttccacccggatatgtattagtgtctacgtgttgctaacgagtgcactcttaatt

SEQ ID NO: 15348 - DNA, 226 bp, Homo sapiens
aatggtaataaagtgaagaggaaaaaactgaatttgtagataagagggagaatgaattgtatgaaaattggggttgattttatgtatttgttgggaaaaattttaaaagtatttttacaaagtattttgtaaatgttaatttttgaggggtatattagttgggatatgaaaatatataaggtgggcatatcattcgtgttatagtgatgctttttgggattcaaat

SEQ ID NO: 15349 - DNA, 197 bp, Homo sapiens
acgaaccaggcttctgcttcagtttaccaacctcagcaaacatcgtttgctttgggagaggaacttaaggactcagcaggaaattgaagataaaatgaaagggttcagcttcaaagaagacactttgctgttgatagctgagggtattggagaagatatcccagaaaaaataaaagatgaaggtcacccagaggtgt

SEQ ID NO: 15350 - DNA, 206 bp, Homo sapiens
agttgatcgcggtgcgacgaggagtagggtgggatctcaccgtgggtccgattagccttttctctgcctggcttgctggagctacagcaggaattccgaaatgggcttggcggtaaggcttggaaaggacctccggaaaggccaaggcaaaagccggtttcccccttcgagagaaagccgcttttcagagtcccagagtgggcccg

SEQ ID NO: 15351 - DNA, 227 bp, Homo sapiens
ggggtgcagttaatctcactctgcagccccacttggcctcaaactcagagatccaactacctttgcctcccaagagctaggataacaagtgtggggtcaatcacggcccaaattaagttttttgttttgttttgttttgttttttggtttaataaagacaagggcctcaatgggggccttggagatgcttagtggttaatgagcacttggcctcccctttcaaagag

SEQ ID NO: 15352 - DNA, 241 bp, Homo sapiens
aagggacaagcatcaagcacgcagcaatgcagctcaaaacgcttagcctagccacacccccacgggaaacagcagtattaacctttagcaataaaccgaaagtttaacctaagctatactaacccccaggggttgggtcaattttcgtgccacccaccgcggtcacacgattaccccaaggtcattagaggccgccgtaaagagtgttttagatcaccccctccccaaaaaaaaaaaaaaa

SEQ ID NO: 15353 - DNA, 151 bp, Homo sapiens
agtaccgcaaggaaagatgaaaattataaccaagcataatatagcaaggactaacccctataccttctgcataatgaattaactagaaatacctttgcaaggagagccaaagctaaggccccccgaaaccagacgagctacctaggaccag

SEQ ID NO: 15354 - DNA, 137 bp, Homo sapiens
tttctggaagaacatagcatttaggttatgagatatatccattttatactctgatagtcaccttgcttgtgtgacattttatcctataagtctataaacccgtatggtttgattattcattaaatgaatcttggtac

SEQ ID NO: 15355 - DNA, 123 bp, Homo sapiens
  misc_feature 21: n = A,T,C or G
tacatcaaaaaaggcactcanaagttatgcacatatcaatgcagcacgagtaacagtctatgaacttgttaataagaaatgggtcttaacactgcaatatagcagccatataaaaatgagtat

SEQ ID NO: 15356 - DNA, 172 bp, Homo sapiens
ttaattgcccaattgagtgcttcatgcctttagatgtacaggctgacagagaagattcccgagagtaaatcatctttccaatccagaggaacaagcatgtctctcttcccaagatccatctaaactgggagtgattgttagcagacccagcttaggaggtcctcttttcttt

SEQ ID NO: 15357 - DNA, 158 bp, Homo sapiens
  misc_feature 34: n = A,T,C or G
ctatttcccctctattgatcccacctccaaatanctcatcaacaaccgactaatcaccacccaacaatgactaatcaactacctcaaacaaatgatagccatacacaacactaaggggcgaccctgatctcttatactaagtatccctaatcattttt

SEQ ID NO: 15358 - DNA, 164 bp, Homo sapiens
tctgttctctctctttgtgagcgacgggggccagggccgtgtaagcttttgctaagtggaaataccctgtccagtatgtaaagtgttttctataaagctttttttttgggaaaggaagaattggagtaagggtttttaattttacccaaactgtaacttttgta

SEQ ID NO: 15359 - DNA, 350 bp, Homo sapiens
gcttcacattctcaggaaccctccttctttggccaggattgctacagttgtgattgggaggagttgttggccattgcggctgttcccattggggcttagtgccattggcttaacttccgccgggattggcttggtcttcataggaggcaagattatgtgtccgcgccgccatattgcaattgggggttgagtgttcctctcgcacacccctggtctataacttcacagactctggagcacatctgagactctccggattaccacaatggatatcctgggctactatggggtttacattgcgtcataatcattgcgaggctactactagctcccttccccgtcgcccagaa

SEQ ID NO: 15360 - DNA, 222 bp, Homo sapiens
ccaattaaacctcttttctctatatattacccagtcttggggatttctttataggcggtccaggattggcttattccagggttcattccggcaggaggttttaccagttttaatttttttggccctcacacattccggacacccggatatatagggcacatcgcgtttgggactctaagagagagagagtacccccctatacacttataccgggagcctccc

SEQ ID NO: 15361 - DNA, 135 bp, Homo sapiens
aaggctgccccctgccccagggctcttcagaaagcatctgcatgtgaacaccatcatgcctttataaagggtccttattacagggaaagggattagttgttgctaaccttaccaattaaggtattttatggttgc

SEQ ID NO: 15362 - DNA, 264 bp, Homo sapiens
ctccttactaccaaactgtagttgtaagcagagggaggggtgagatgtttataggacattccctaagcttgggagttatttttatcactatttatttcaactttacttttggatagacttcctataaattttattatatggaaaggctcaaataaaaactatgcatgctatatctatgtgtctatatttatatacagagaatatgggtctatgtgtctccacagtgtatacacagagtatgtgggtgtgatagagctctctcct

SEQ ID NO: 15363 - DNA, 207 bp, Homo sapiens
tcaataagtaggactctctttgaagggctggaggagtaaaaaaaattgcaaactcttccattttataatttttctttatataatcatatttagggcccttatattcagggggatggaatgctttctctatacccggggtaactcaaacccggagatttctaagagcaccccatatataaaaattttgggttgtcacataattactcw

SEQ ID NO: 15364 - DNA, 180 bp, Homo sapiens
accgcagataagtttttttctctttgaaagatagagattaatacaactacttaaaaaatataggcaatagggtacttaggtattgcttaggggtaaggttttaacggaattttaataggctaagagctttaagagagaaatatataagactctggagagagtatgcatttagggagaaaa

SEQ ID NO: 15365 - DNA, 274 bp, Homo sapiens
accgcagataagtttttttctctttgaaagatagagattaatacaacttcttaaaaaatataggcaatagggtcctaaggtattgcttagcggtaaggttttaacggaattttaatagcctaagagtttttagagagaaatatatgagagttatgagagatgggcaatgagaggggaaagagataaagggttttcctaaccactactcgcgcggtgtgagatgcgtctcttactagagtgtaaaacgttttatatttggaaacttgtggaacgr

SEQ ID NO: 15366 - DNA, 212 bp, Homo sapiens
agcagtgattaacctttagcaataaacgaaagtttaactaagctatactaaccccagggttgggtcaaatttgtggcaaccaccgcggtcaaaagagtttaaccacaggcaatagagaggccgcgtaaaggagtgtttttgagtcacacccctcccatgtagagtaaagatctacacccggagtgtgatagaaacactcagtgtttgacaca

SEQ ID NO: 15367 - DNA, 200 bp, Homo sapiens
cggtggacctgctccagcagctggtgctgcaccagcagggaggtcctgccccctccaatgctgctgcttcagctgagggagaagaaagtggaaggaaaggaaggaggatcccaggagtctgatgatgacatgggctttggtcttttttgaataaaactcttttataacataggtcaataaaaagcgcgaacatttagaga

SEQ ID NO: 15368 - DNA, 251 bp, Homo sapiens
cacaacaccaaagaggcttcttattcgggtgtgagtcttttcagcaaccccggtccagtacttgggggatacagccatccaccttcaggtgttttttacgtggcggttttccattaaactcggaaacttttagtgatttttaaggagcccttaatttttttacccgggcaaaatttttttaattaaattctctaaaaaataaataaagggtaagatattgggccctcactccaatgtgggtgtttcccccc

SEQ ID NO: 15369 - DNA, 201 bp, Homo sapiens
aagccaagctgttgtcattttcattcggtgacattctctcccatgacaaccagaaaggggcaggagaaccacaatttttcatttattaggtgtttgcaatccccttgtattaaaaattatttttggggggggtgggcttaattggttgggtttttttttttttccccccggggggaggggggaaaatttttcttgggattt

SEQ ID NO: 15370 - DNA, 178 bp, Homo sapiens
aacatgcacaatagtatgtttttattactggtttaatggagtaatggtacttttattctttcttgatagaaacccgcttacattttaaccaagggttctatttattcccttttctaaaaaagggtttcttcaccttctttcaaattaaaaggatttaattgctctaaggatatatatb

SEQ ID NO: 15371 - DNA, 372 bp, Homo sapiens
tttccttacctccctccatgctgtccacttcctctgtaaagctctcaaccctgtccccttccccctctcttcctggggaaaggggcccttcccatgcctagctgctgcttttaaggggcccttttggctaaaggccgcggggagggaatccgattcttccggaattttctctcccgacctcccgggttttgggtttcagaggttcctaaatgtcccagggggaggaaggcccgggcggagtttgaaataggggggtttacccgggcgagggcacacgcctaaaaatctcagcactcggggaggccgtagggggccggacacgaagacaggagaccgaaaccatctcgacaacagggataaaaccccatttcg

SEQ ID NO: 15372 - DNA, 240 bp, Homo sapiens
tcctgctgtgccagaaacccttaagaaaaagcgaaggaatttcgcagagctgaagatcaagcgccccagaaagaaggttgcccaaaaggtgcttcggaaggcaaggaggaaggttatctattaaaaagaaaagaacttttacacagggatatatgggacagtgtatacagactctaaattcgcgattgggcggggttggacaaggaaaactctgcgcatcatctttttccctaaagaccc

SEQ ID NO: 15373 - DNA, 102 bp, Homo sapiens
accactgaagaaagaccgaattgcaaaggaagaagggagcttaatgccaggaacagattttgcagttgggtggggtcttaataaaaggtatttttccactga

SEQ ID NO: 15374 - DNA, 364 bp, Homo sapiens
actcctagaaacacccttgaccaaacgttgtgtctttgatcggaaatgctgtctattgagatatacctggtgtttttgttgagtggaccttaaacctaaagggtggtctgaatgaatatcaaaggtttcctggatatagggtggggacaaatattccagggtcggggatttgtgtattggcatgggcgcatatttcccctctcccaagagcccgggcccacgccaaaccccccagggtatgtgcctctgggcgactccccggagggccggtatggcactctgcgcgtgcgtaccgactgccccgcgcttttccggtggagcgtggtaggtgtactcgctagtcgggacccgccctcgagatcct

SEQ ID NO: 15375 - DNA, 254 bp, Homo sapiens
aggtagatgcaggcaagggaaaactgaataggagcaaattgatttctagggaaaaaccaaaaaaccaaaaacaaaaaccagaaacaccaaattgtagagggttaaaatcgataatatattatggggattggcctttctctttgtttataaaatgtctcaaaactttattaatactctggattttttattttccgagaaaagactctgtgatctacagtggactctaaaaatttggagtttagcattagagagac

SEQ ID NO: 15376 - DNA, 310 bp, Homo sapiens
cagctccaaagcattggatgctggataaattgaccggtgtgtttgctcctcgtacatccaccggtccccacaagttgagagagtgtctccccctcatcattttcctgagggaccagacttaaggatgcccttacagggggatggaggaaaggaggttttaaattaaaggggttaaataaaatctggaagggagggccccgacttakatatacactacccgtcactggagtaagggaaggggactgggcatacacaaacggggggagagattttccgtgtgatatatgaaaaagagaggcgcttctttata

SEQ ID NO: 15377 - DNA, 208 bp, Homo sapiens
caccaaagccacctttgcacagaaaaatctttgggcgaggttgaggcccctcccctaattctctccccttccttcccttaagcaaccattggaccacaaaattatcaccttatgagaatttcatgggcaaaggaaacaagaattaaaaccaggcaaccataacaagtatacaaacatcccaatatatacttttatggaaatagccata

SEQ ID NO: 15378 - DNA, 115 bp, Homo sapiens
gcatcagtttggttggcagtattggcatgcatatagtgggtgtcattgattagtcattcagtgtttttttatcaataggtgcaattatattctaaattgtcgtgtggttttattt

SEQ ID NO: 15379 - DNA, 129 bp, Homo sapiens
gggacctgcttctattagcccttctccatggccctgccatgctctccaaaccactttttgcagctttctctagttcaagttcaccagactctataaataaaacctgacagaccccaaaaaaaaaaaaaa

SEQ ID NO: 15380 - DNA, 187 bp, Homo sapiens
ggtggtggccactgcgcagaccagacttcgctcgtactcgtgcgcctcgcttcgcttttgctccgcaaaccatgtctgacaaacccgatatggctgagatcgagaaattcgataagtcgaaacttgaggaggcaaagacgcaaggagaaaaatccacttccttccaaaagagacgattgacacaggg

SEQ ID NO: 15381 - DNA, 251 bp, Homo sapiens
gacaacttgattcctaaggtttccagtgtgtcaccacaaaaaagtgcattgatagggacctttgtctcttcctccctttgattaattgccccgcatcacaggttactagattacctagtgttacatcatattaaataaaatgtagcaggaccatctgcaacaatatatttctgtttagagtttttgcaggagagaaggtaaaaggagtttgctcccctgtatgatgtgagtcgcgcaccccacattttgta

SEQ ID NO: 15382 - DNA, 273 bp, Homo sapiens
ggagacagcaatattattatgttcacatctaactccagagcttacttcctgtggtgccaatgtatttgttgcaatttactacatttttatatgagtctatttataggtgccattaaactcaggtctttcaaatgaaagagtttctagcccacttagggaaaaagctaattgtttagaaaaccataaaatcaatggtaggaaaagttggaactggttacctggatgccatggttctctgttaaataaagtaagagaccaggtgtattctgagtg

SEQ ID NO: 15383 - DNA, 142 bp, Homo sapiens
ctcattttatgtatgttacccttcagtaagttctccccattttagttttctaggactgaaaggattcttttctacattatacatgtgtgttgtcatatttggcttttgctatatactttaacttcattgttaaatttttgta

SEQ ID NO: 15384 - DNA, 328 bp, Homo sapiens
ctagcttcaccttcacgatgtttcccttggccaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttgcagagttaccccaaaggaatggaggaatcagtaatcatcccagctggtgtaataatgaattgtttaaaaaacagctcataattgatgccaaattaaagcactg

SEQ ID NO: 15385 - DNA, 413 bp, Homo sapiens
ggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttaagtataatacccacacccacccaagaacaggg

SEQ ID NO: 15386 - DNA, 241 bp, Homo sapiens
taggcaccttgccctgtgactcctctctagaaccctgcagacttttatcaagtatttggctacaagcaagttttttgtgaaaccagtggaagagtctgttctgcctctctcaactggcctaggatgggatggaactttagagcacaggcatatttaggagtttagagacataattcttaggagaataagttctatgaacttttcagaagcagtagggtagggctatgaactctatacatat

SEQ ID NO: 15387 - DNA, 157 bp, Homo sapiens
gctataatagaaggattcccatccctgagcttgaagcaagaattgatgctgtgaatgctgagacaattcgagaaagtatgtaccaaatacatttataataggagttcagctatttcttctggtgtggtccatttaggcaacttccagatttttaaca

SEQ ID NO: 15388 - DNA, 180 bp, Homo sapiens
agtaagatggaatttcagtgagatatggaccaccggagtcagcgagagtgacttaaacagaagcgatacctctcgcttccatggccatcactacagaccccaagtcaaggatggatatcataggcctttacttcttcaaaggccaaagggaggcccctgtggttgtctctaaggttttat

SEQ ID NO: 15389 - DNA, 286 bp, Homo sapiens
taactactatagtggatggaaagactggctaagtttttgattaacactcctttctcttagttccgtaggttttagttagtgataaagattaaaactttttttgatatgttgctttaaaatgttagtaacactttaaagtccgttttagataataaaataaccatgtagatcaggagtaacttaaaatgtatggccaagtgtggtggctcctgcccgtagtcccagcactttgggaggccaaaggcaggcagataaccgtaggtcaggagttcgggactcagcctcg

SEQ ID NO: 15390 - DNA, 172 bp, Homo sapiens
ctttcccggagtacctattgtagataacactatgggtggggcactcctttcttgcactattccacagggataccttaattttgtttcctctttacctgttcaaaattccatttacttgatcattttcagtatccactgtctatgtacaataaaggatgtttttaagagagcg

SEQ ID NO: 15391 - DNA, 228 bp, Homo sapiens
agataatttttagcttagggcctggtggctaggtcggttctctcctttccagtcggagacctctgctgcaaacatgctccgagatcatcggtcaggccaagaagcatcccagcttgatccccctctttgtatttattggacctggagctactggagcaacactgtatctcttgcgtctggcattgttcaatccagatgtttgttgggacagaaataacccagagccct

SEQ ID NO: 15392 - DNA, 217 bp, Homo sapiens
gagcctctctccctactgctgctacacaagaccctgagactgacctgcaggacgaaaccatgaagagcctgatccttcttgccactggccgccttagcggtagtaactttgtgttatgaatcacatgaaagcatggcatcttatgaacttaatcccttcattaacaggagaaatgcaaatagcttcatataccctcagcagaaatggggactaaagt

SEQ ID NO: 15393 - DNA, 143 bp, Homo sapiens
cttttgcactcaaattcctttatcaggaataactacatagccactatttacaaagccattggaacctttttatttggtgcagcataataaaaaactaaactgacattgccaagtattctaataaagacaggctgcggacctca

SEQ ID NO: 15394 - DNA, 242 bp, Homo sapiens
gcatcaagcacgcagcaatgcagctcaaaacgcttagcctagccacacccccacgggaaacagcagtgattaacctttagcaaaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaaaaccattgtg

SEQ ID NO: 15395 - DNA, 319 bp, Homo sapiens
taaataatcagggatattacatgtatgttgcatcatttaaaaggtgtaaatatataggatagaaatatttagcatcgtgcatttatatatcccgctttgaggtttcagttatgaaagaactatggtaattaagactggacgggataaagccacatgctaatgtcagaaaaaggtctttaacagatagcaaaaaaagaaaatgtgggtcctagaatgtgattcctctagtggtatttgagtggggttacaaagttccagtttagattttaattggagaggtagaactttgccttaaaacaaattgttacaggcaaaactc

SEQ ID NO: 15396 - DNA, 356 bp, Homo sapiens
gccctgtgactcctctctagaaccctgcagacttgtatcaagtatttggctacaagcaagttttttgtgaaaccagtggaagagtctgttctccctctctcaactggcctaggatgggatggaactgtagagcacaggcatatttaggagtttagagacataattctgaggaaataagttctagaactttgcagaagcagtaggtagggctatgaactctatacattgtaaggttcgacaggcaaacatctggatgtatctgtcacagcaactaatgtcttagagaataaggtatagcttcaccaaacatttgaggaactagtagtaaaagtaatcaatgctaataaatgacagta

SEQ ID NO: 15397 - DNA, 187 bp, Homo sapiens
  misc_feature 31: n = A,T,C or G
cacagcctatttctgagccaagggatggggnagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgcaaa

SEQ ID NO: 15398 - DNA, 214 bp, Homo sapiens
  misc_feature 30: n = A,T,C or G
tctaggtaggaaatgtggtagcctcacttngaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctat

SEQ ID NO: 15399 - DNA, 450 bp, Homo sapiens
  misc_feature 203: n = A,T,C or G
taaataatcagggatattacatgtatgttgcatcatttaaaaggtgtaaatatataggatagaaatatttagcatcgtgcatttatatatcccgctttgaggtttcagttatgaaagaactatggtaattaagactggacgggataaagccacatgctaatgtcagaaaaaggtctttaacagatagcaaaaaaagaaaatgngggtcctagaatgtgattcctctagtggtatctgagtggggttacaaagttccagtttagattttaattggagaggtagaactttgccttaaaacaaattgttacaggcaaaactaatctaaagaagtcagaattataatgacatttccaaaagaatattgactaggaggaggctgaaaggagccatctgaatgctgaaatgtactggctctgggtagtggttcatgggatctgtgaacaataacta

SEQ ID NO: 15400 - DNA, 219 bp, Homo sapiens
gtaatagcttggatggttttgagaaaataacctgtatttatcacattgtcaaacagaatttttctttgaatcagacaagttcagctctaaattgatgtgctatatacttaaaatcctaggaagttatctgtaaccagtctcttgtctcaggctcttcaccttgttaccaatcctcgtaagtatgtaaaggaaacatatttttacaggagcttaacagta

SEQ ID NO: 15401 - DNA, 116 bp, Homo sapiens
taaagatattaagacggtgaggaacaatcagaagagggaataacagcccatttgagggggggaaaagagtggcacattcccatccacatttttaaatcccgaattgacttgagaaa

SEQ ID NO: 15402 - DNA, 233 bp, Homo sapiens
ggtttttatttcttagaaaaatttgatatccatctctatatgttattcacatatttcagttcattttctatttcgagttttcttcttaattatatttccagttattgttacctcctagtttattagatgtattttggatttgtaaattagtttttgtattcattacctaataaggttgttttcaaaggcaattgtattttaggatttgcccccttggtttcagagagagcgtg

SEQ ID NO: 15403 - DNA, 241 bp, Homo sapiens
gaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacaatttatgctgatcttcaggtcatatattctctcccaggaaactctagagctcttcccactctcacaataaatatctctgggagaga

SEQ ID NO: 15404 - DNA, 165 bp, Homo sapiens
gacatttggagcatggccaacaggaaggtcagcttcttactgatgtgtgtggattcttacagaatgttagtacaaatttttataaatatttggggatccctggggggaaatatcaattcttactatgggtaggaaaggtaattacggaaattttcagctcagttt

SEQ ID NO: 15405 - DNA, 204 bp, Homo sapiens
tgaggcagccagcgcaggggcttctgctgagggggaggcggacttgaggaaaccgcagataagtttttttctctttgaaagatagagattaatatcaacatcttaaaaaatataggccattgggtacctaggttattgctagggcgtaaggttttaaccgtaattttattagcttaggattttaggagaaatatatgacggact

SEQ ID NO: 15406 - DNA, 167 bp, Homo sapiens
  misc_feature 97, 98: n = A,T,C or G
ggtgatatgagtgctaaaaaaatttctttctagtagccaggaaacagatagataagataaaagcaaatgttccagatttaagtcttcttagggtgannccaagggagggaggaattggtttggaagggccatttttaggcatttaataattttaaaaatggatttts

SEQ ID NO: 15407 - DNA, 205 bp, Homo sapiens
tattctcttatatgttatagtaatgtaacgtataaactcaagcctttttattctttgtgattaaatcctgttttaaaatgtcacaaaacagggacccgcattcttaattaggtttacctttatcaaggtatgggttcaaatagggccttcttggggttcattgaccacttaaacctttgaagcatttacttttttatattaaamr

SEQ ID NO: 15408 - DNA, 135 bp, Homo sapiens
gcctgatccttcttgccatcctggccgccttagcggtagtaactttgtgttatgaatcacatgaaagcatggaatcttatgaacttaatcccttcattaacaggggaaatgcaaataccttcaatattccctcaa

SEQ ID NO: 15409 - DNA, 249 bp, Homo sapiens
tgaggcagccagcgcaggggcttctgctgagggggcaggcggagtttgaggaaaccgcagataagtttttttctctttgaaagatagagattaatacaactacttaaaaaatataggtcaatagggttactaaggatatttcttaggccttaaggtttttaacggtaaattttcataagcttacagattttcaggagaaaattattaggaccttagaagagttgcactagagagggaaaagaataaagg

SEQ ID NO: 15410 - DNA, 106 bp, Homo sapiens
ttaagtgcacccattcttgattcgttctaaagcccgtactagatagccagttgggtggtggaggaaggagtttgccgccgtcgggtcttgttgtcctgctcctttk

SEQ ID NO: 15411 - DNA, 165 bp, Homo sapiens
  misc_feature 119: n = A,T,C or G
gaaggaacaagcaagtatgagaacaaaatcccaaaatcaatggcgggggcataaaatccccatggaggtatggcaatattaatatgaggccaagcaaatccaccccccttgcaacaaanagtataatccccattgttaagacaaaaaccccgtcaacaaaatttt

SEQ ID NO: 15412 - DNA, 182 bp, Homo sapiens
cttctgctgagggggcaggcggagttggaggaaaccgcagataagtttttttctctttgaaagatagagattaatacaactacttaaaaaatatagtcaataggttactaagatattgcttagcgttaagtttttaacgtaattttatagcttaagattttaagagaaaatatttagactta

SEQ ID NO: 15413 - DNA, 137 bp, Homo sapiens
cctggaggtcaatcaacttgagaagtttgacataaagagcttctgcaagatcctgggggccattatcctactccaagatcaagcatttgcgtttgggatggcaatggcatctaagaaaccagtctttccccggatat

SEQ ID NO: 15414 - DNA, 222 bp, Homo sapiens
acacatgcacatgtatgtttattgtggcactgttcacaacagcaaagacttgggaccaacccaaatgtccatccatgatagacttgattaagaaagtgtggctacaccatggaatactatgcagccataaaaaagggtggggttttttcctttttaggggcatggatgaagcttggaccctcattttttgctattttttacaagggcagagaaccacacacc

SEQ ID NO: 15415 - DNA, 201 bp, Homo sapiens
tttggtgatgagaacccattctaggtaagggaggatgccaggaaagagtagggccttaagaatgtccgagtatcccgggcggggtggctcctgcctttaatcccagcaactttgggaagttgaaggcggacagataaatttttagttaaaggggttggaccagccttaccaaaatgggaaaaccccatctctccccaaaaa

SEQ ID NO: 15416 - DNA, 410 bp, Homo sapiens
aagtgttgagctttattttgctttttcatagaggcagaaagtaggaaccagatagagatgaaaaggggccacttaaaagtgaatttgatagctcagcatttaagcatgattacatatttcagatagctcttttttgctctctataaatatatgcacatgtgtgtgtagtgatagatgtaagtttacacactgagagggagatctcgtctcacggtgtattataaaagcctcgctaatatagtagggatgctctcctccggttgtacagcaggtacatttgtaaacctccatgctgtaaatggagtttgttttatctctctggggttacaacagcaatcatagtgtacatacacggccctcccctctctcgacctcgcaatatagggattgtataatgaaaataaatctct

SEQ ID NO: 15417 - DNA, 520 bp, Homo sapiens
cttctgctgagggggcaggcggagttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcctcatggagtaaaaaatgtatttaaaagaaaattgagagaaaggactacagagccccccattaataccattagaagggcaattcttttagattaaaatgaaggtgacttaaacagcttaaagtttagtttaaaagttgtaggtgattaaaataatttgaaggcgaagaaaagaatagagaagatagggaattagaagataaaacatacttttagaggaaaaagataaatttcaccctcaaaagtaggaagcagaagaaaaagacagctgg

SEQ ID NO: 15418 - DNA, 440 bp, Homo sapiens
tgacaactgtttcctccctgaccccagaggatctggctctaggttgggatcaatcctgaatttcgttatgtattaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctcggtgtgtgtattagaatcccttcctgccttgtttcatggcagtgaaatgcctcttggtgctgtccaagtgtatctttcactgatttctgaatcatgttctagttgcctgaccctgccacatgggtgcagtgttcatctgagcataactgtactaaatcctttttccatatcagtataataaagggggtgatgtgcaa

SEQ ID NO: 15419 - DNA, 173 bp, Homo sapiens
tatttgtcagtggccttcaaagaaattgtttatactgttctagtaattatatatccaggatcctatcctaaggaaaagttgaagttcaacacaaaggtttatatatgagaacattaattacagctatgtttatgtttgttagcagtaaaaattaccaaatactaaacggcccc

SEQ ID NO: 15420 - DNA, 204 bp, Homo sapiens
tgcagttctaaacagatgagtgtggtcctggatgaggtccagcagtgagccttcacttaacttaagggaccttggattatctgaactaaaaattggacagttgatcagctggtagaaaatctacttcctggaattttgtaaaggcaaaaacaattcttccattgggcatacatacccatggtctcttgcacaaccctttctttg

SEQ ID NO: 15421 - DNA, 122 bp, Homo sapiens
atctcttgtacaaacgatgtgctttgaagatgttagtgtataacaattgatgtttgttttctgtttgattttaaacagggaaaaaataaaagggggtaattgctttcttttttctatcttat

SEQ ID NO: 15422 - DNA, 258 bp, Homo sapiens
ctagcaataatgatatttaaaggaataatttttttggtatggtccatacttccaccaattttacagggtatatttacaaggccctcaaacacattaaacattcaaggttatttgggagggccccttattggtcttttccctggacacagttgggtttttgggccaatggtgggtgatggggcaattccccatttgtgtgtcccgccacaagacttccggagtgtgtgtgtgtgtgtgtatcactatcccggcccatgt

SEQ ID NO: 15423 - DNA, 223 bp, Homo sapiens
tggatcacaaggtcaagagattgagacaatctgaccaacacggttgaaaccccatctctactaaaaatacaaaaattaagctgggtgttggtggcgcatgcctgtaagtccaacctactcaaggggggtgaggaagacaaatcactytgaacctgggaggttgagaggtcccactaacccagagatgccccacactgctttccaggtctgtgtaaaagagaag

SEQ ID NO: 15424 - DNA, 226 bp, Homo sapiens
acaagatggttacatctcggacggacaagtgttggacagccggagtcagtcttccatgggagattatctttggataaccagatttcctcctgggggatagggctagttttgtgggtttgggttttctaaaactcttctttaccagggttgtaaaaaggggggggctctttgtgaactccctctctttcaaagtatgttttgtgggagtggggcacacactgacaca

SEQ ID NO: 15425 - DNA, 155 bp, Homo sapiens
aattgaacaatgagatcacatggacacaggaaggggaacatcacactcttgggactttttgttgggttggagaaggttgaggggtaacaattgggagatttttccaattttggttaagaagtaagtggttcgggacacacacaccattggtgaca

SEQ ID NO: 15426 - DNA, 201 bp, Homo sapiens
ctctttcctcagccttaaggaccatctgccaaaaattactgatcctcgcatgatggcagccatagagcataggttctaaaattagttaccttgaacatatcttaggtgtgggaggccttgcggaaaagggaggagaggttacaggtaaccatattatagggttttaaagagagagaggttttgggcgtatctcacatctca

SEQ ID NO: 15427 - DNA, 151 bp, Homo sapiens
ccaaatcttcttgatattgtgaattgtactccttccagtttaggttcttctgggctttccttaactgactaccctttaattttaatttaaaattgcacaaattatggtttaaaatggggctctccatgtgatggtcccatttccccacaaa

SEQ ID NO: 15428 - DNA, 200 bp, Homo sapiens
tccaagatattgacctctgtgaaaacagcgtgcagcggcacattggacatgctaacctcaacttcgggcagcttcggagcttggatgggaagcttaccgggaaaggaagttgggagccgggaggcatttgtaaaaaacatttagggcatacccaacccgttaccccgtttctcgagagtctctctgagttatggggcgtt

SEQ ID NO: 15429 - DNA, 152 bp, Homo sapiens
aatgtacattttcccctaggtctagggagtatttacagaagttgatcatgtcatttatcacagaaaacaaaaagtgaaatatgaaaattttgatttttgtatgcaataacccgtcccgtcagtcccgtgaaattaggtgggaaaaaaaagag

SEQ ID NO: 15430 - DNA, 195 bp, Homo sapiens
ccctggtaaactctgcgcttcactgtcttccattatgcccattatgcaaaaatcttcctcttctttttgccgggttttgccccctctgccattgtggttatctggtgctggggtccaattccccattttagcctatttctttgccttgctcccccgggcctagggcggctttgtcctaggttctacctatatatg

SEQ ID NO: 15431 - DNA, 121 bp, Homo sapiens
catttggatgtcttgacaggggctttgcagggatttttagggtttttttcacattgtccacattaatgggtggcatgattgtgctttcagggcaaggaatggtcatcccccttggcaaagg

SEQ ID NO: 15432 - DNA, 183 bp, Homo sapiens
tatttttaaaaatcatggtgatgtatttattagaatgtttcttataaatctgtttactttttatattaaggattaaactgtaccccaaaaaactttggctatttccaattgtcaggttaggaaatacaatttctttgggccccagaaattaaatccctatattttatataacccccttttttg

SEQ ID NO: 15433 - DNA, 187 bp, Homo sapiens
atcccaagatggacccaacatcacttccgtggtgctcctgcccaaaatgcgttattctgagctaatcaggggggaatattaggcaaaccccaattaagggacaggctacaaaatattccgggtttttctttttaaaaagggtccatggtaaatggaggccagaggggttggggaaacctttttttgg

SEQ ID NO: 15434 - DNA, 202 bp, Homo sapiens
agaaggttggttacttggtgaacaactacttgttatatgcttcccctcttggttgccctaaggacatcgtagtaaaaatactttgggatattctgggatattttgttactcattttgtggtataaaaaggaatttttaggtacacgggtttattatgggggtaaggattttttcacagggggacaaacccgggggggtttty

SEQ ID NO: 15435 - DNA, 231 bp, Homo sapiens
gacaggatttggcccagctcatgaattcgagcggctctcataaagatctggctggcaagtatcgtcagatcctgggaaaagcccttcagttatcttgggcaggacaacttggagctttgaaagcttttgttggagcaattgttaattagaatttcagtctctgtggttttgcggggagatttcttcctctgtttttttaacacaaattttctctatttgtgctcttttgga

SEQ ID NO: 15436 - DNA, 150 bp, Homo sapiens
cacaattagtcacaataataataatgattcagccgggcacggtggcacacacctttaatcccagcactttgggaggccaaggtgggtgggtcactttgggtcaagagttttagacccaccttgccaaaagggcggaattcgtttttttca

SEQ ID NO: 15437 - DNA, 211 bp, Homo sapiens
ctattataccaattttcaaagcattggtcaactcaaaatgccattttctttggatggtttagatgattctcaatacaattttggtatattgattcaaataaatgttaccaaatcctcagtaaaaaatgtttccctggggaaataaggatggtttcaaacaaatggaatcttaggggttccccatgaatagttgggagagtctctagagaaa

SEQ ID NO: 15438 - DNA, 134 bp, Homo sapiens
ttgacaaagaaaaatgatacttctctttttttgctgttccaccaaatacaattcaaatgctttttgttttatttttttaccaattccaatttcaaaatgtctcaatggggctataataaataaacttcaacagt

SEQ ID NO: 15439 - DNA, 152 bp, Homo sapiens
tctaggtggaggttgtgcatgttgtcctttttatctgatctgtgattaaagcagtaatattttaagatggactgggaaaaacatcaactcctgaagttagaaataagaatggtttgtaaaatccacagctatatcccgatgctggatggtat

SEQ ID NO: 15440 - DNA, 285 bp, Homo sapiens
aaaattcaacacaccttcatggtaaaagtcactgagcataaagaagggaatttccttaacctaataaaggacattttgaaaatacccgcagctaacaacatattcaatggcaaagactgaacacttttctttaacatcaggaacaagacaaggatgtctgctttgatcactagtgaacattgcaacttctagcagagcaattagcaagatagacaaataagaggcatccaaactggagagggataaattatttctcttttcagattacataattctacatataas

SEQ ID NO: 15441 - DNA, 331 bp, Homo sapiens
gaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgtattttcatgtacaaatacggtaatgctgtattagctagtggagccactttctgtattgttacatggacatatgtagcaacacaggtcggcatagaatggaacctctcccctgttggcagagttaccccagaaggaatggaggagtcagtaatcatcccagctcgtgtaataatgaattgtgt

SEQ ID NO: 15442 - DNA, 119 bp, Homo sapiens
tgtgtttctgtctgttaagtgcatctagtgagagtgaagctgaaaatcttgaagcacaaccccagtctactgtccgtccagaagagatccctcctatacctgaaaatagattcctaaaa

SEQ ID NO: 15443 - DNA, 149 bp, Homo sapiens
tataaaaatctgatggcaaagcaaaacaacttggaaagtaggggaggtggatgttacaacaacttccaaatttggctcttttggaggcgagaggaaggggagaactttggagaaagtttttttcttttgggggtagaggcttttttaga

SEQ ID NO: 15444 - DNA, 103 bp, Homo sapiens
agtggctcctgtcgcagtggcactttttttgcacctggtcttagcagtgcttatgctgagcaggtcataagattcttggagtttaaaaaaaaataaaagagam

SEQ ID NO: 15445 - DNA, 328 bp, Homo sapiens
aaccaacctccgagcagtacatgctaaggattcaccagtcaaagcgaactactatactcaattgatccaataacttggaccaaccggaacaaggttaccctaggggataacagcgcaattcctattcttggagtccatatcaacaataggggtttacgacctcgattgttggatcaggacatcccgatggtgcagccgctattaaagggtgcgtttgttcagcgattaaagccctacgtgatctgagtccagaccggagtaatccaggtcggtctctatctactacatatctctccctgtacgaaaggacaagagatatagggcctac

SEQ ID NO: 15446 - DNA, 258 bp, Homo sapiens
tcaagctaataaagcaaagaatccgatggtggatgaattaaagaattagagaagggaaggaagaaaagaaattaaaatggagaaaacagatgaaactaggttacagcagggagcagaatttggaaaaatccgctaaggaaaatttaagagagatctaaggaattgagagaattttgagagcacatgcacaatagagagacacacattgctctataaaatcggagagaccccaagagattagagagagagagatgagag

SEQ ID NO: 15447 - DNA, 201 bp, Homo sapiens
gcctggccctttgggagtacactgaaaggtggggatgttgggggcatgttccatttccccctccctcctggaggacagatctcagttctgtgctgtctctatgcctctcacagctatgggggccttgggaaagtccctgtccccttagctgccccaggggatcttgactatgtagattctttttggcaccctttttgaaaa

SEQ ID NO: 15448 - DNA, 159 bp, Homo sapiens
ggttatggcaataatcatcatgatagtagttaacaaatactgattgcataatgtaactctaactattttcacatttatttatttaacttttttcaacatttttctgtaatatatcacttgtggtttacttgccccaatagggcccaaagggacttattt

SEQ ID NO: 15449 - DNA, 121 bp, Homo sapiens
ggacgagtagttgtattcatgcagtagtttgaaataatttactcaagacccagaggatgccaggtggatcctacaaagctacaagagcagagaaccctctccgaggctttacaaagaacac

SEQ ID NO: 15450 - DNA, 171 bp, Homo sapiens
attcgttgaaggacaccagctgcgggtttgcggctttggcagattgaaatcatggcaggtccagaaagtgatgcgcaataccaagttcactggtattaaaaaaataatttcaacctcttataactctcacaaggtgggattgaacctgtgtacctgtccacaatatggggg

SEQ ID NO: 15451 - DNA, 195 bp, Homo sapiens
taaggaattgcacatgagatggcacacatatttatctgtctgaaggtcacgatcatgttaccatatcaagctgaaaatgtcaccactatcttggaggatttcggaccgtgttttcctctctgaatctttttattgaacacggttggttggctggaattcaggataattaaattattgttaagggcccttcctttt

SEQ ID NO: 15452 - DNA, 299 bp, Homo sapiens
gtagtctgttaaataaacactccttttaaagacatctgagaactaggttaatattgtcctctatttgtaagcccttgagattctagacacatatgactttttcaaaacccatatttaggatctaaaaagcagccagctgtgcttcatctctgagtcattctgctcttctcaatggagaccttattggcccttccttgtgctgtctgtgttggaggtgttccctagtcattgtaaaaataacctgtgagggtattgaaatttttaggggggcttgacaccagcaaaaaaaaaaccaaaac

SEQ ID NO: 15453 - DNA, 220 bp, Homo sapiens
catctttaaattactaactttttatagtaatgcctctcgtcctagtaggagataaactttttgggctaatcggatttgcctcagcttctctgtcatatttaaaaacaaaggaaatgttcaactattacagaatattctgtgatctctcattcccataaggtggtaggaatacatactgaaacagccttcactgtatatatctaaatcatttaaaattaat

SEQ ID NO: 15454 - DNA, 253 bp, Homo sapiens
tcgtagctggaaagtgttgatctgggttttctggcattcttttaagttaaaaagttaacatcgggacatgggtttgatcttttgttgtacctcatgacagtgcagagattctccacagctggataaaaatgtcacaaagctacttactgtacatgggcagtatcagatttcaaatcctaatatttcagctgtgcttttaatactcaaaatattaggggatggggtgttgaaggtttcccttttttgcttttaa

SEQ ID NO: 15455 - DNA, 263 bp, Homo sapiens
ttcgtcacacatctaaatgagaaatcagtgacaacaagtctttgaaatggtgctatggatttaccattccttattatcactaatcatctaaacaactcactggaaatccaattaacaattttacaacataaggatagaatggagacctgaataattctgtgtaatataaatgggttataactgcttttgtacctaggctagggtgctattattactataatgagtaaatcataaaggccttcatcactcccacatttttttta

SEQ ID NO: 15456 - DNA, 240 bp, Homo sapiens
aaatcatgaaaaatttggattatggtggagcctagagaagtctcagtcgtatcttaaggccttggatttgaagaagggccaaatcatgcaagatattttatgtcatgttaaggattttggaggctcatcatagaaaacatagtgagaagctcttaaagaggatgtgacatgttcagatttgcatagtacatatgacattgacttttaacctcgggcaacatggcacgactttgtctctgc

SEQ ID NO: 15457 - DNA, 256 bp, Homo sapiens
gttcaactttaaatttgcccacagaaccctctaaatccccttgtaaatttaactgttagcccaaagaggaacagctctttgggcactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccattctatcaccctatagaggagc

SEQ ID NO: 15458 - DNA, 183 bp, Homo sapiens
caacaattctttcacttaccagatgcccctcaatccccatcataatggtgggtccaggaaccggcatagcccgtttattgggttcctacaacatagagagaaacttcaaggacaacacccagattgaaatttttgagcaattttggttttttttttgcttcaggcattcaggataggggtttt

SEQ ID NO: 15459 - DNA, 209 bp, Homo sapiens
ggacagcatcagcacgcagcaatgcagctcactcgcttagcctagccacacccccacgggaaacagcagtgattaacctttagcaataaaccgaaagtttaacctaagctatactaaccccaggggttggtcaatttcgtgccgaccaccccggtcacacagattaaccccagtcaatagaagcctgcgtaaagagtgttttagatcac

SEQ ID NO: 15460 - DNA, 151 bp, Homo sapiens
aaaaggcttcttattcgggtgtgagtcttttcagcaacccggtccagtactgggagatacagccatccaccttcagatgtgtcttacgtgccgctctgccattcacctagggaacctataagtacttctcaagaaagccctcattttttta

SEQ ID NO: 15461 - DNA, 254 bp, Homo sapiens
acagacaagttttcttttacgttccctatgcttcctggattttctctttctaggtttactcattccttagggtcatggtttttcaggtcttccctcattgcttagggtcaagacttttccccttgttccctccacatggttgttgaaatgcaaagctttaggttaaaggatcagcagttacccttagagcagccacttttttcaaagcccattcattatgctagatttttacttcagagtttttttttttgagg

SEQ ID NO: 15462 - DNA, 190 bp, Homo sapiens
tagggtgaaaatttttaaacacaaggaactctggcccatagcacaatggtgtccctaaagagagaagggagagcatgtagcacacaaacaaaagagaataaatagtggccaaaatttccgcaagtaggttaaagattcaactttctaggtttcaagaagttcagtgactcccgacttatgtgataactgy

SEQ ID NO: 15463 - DNA, 120 bp, Homo sapiens
gactttcatgatagaattagcgctcttacaagagagacactaaagagcctgcttgctctctctatagagtgtgaggacacaattagctctcagcaggcaaaagaaagagtcagcaatttt

SEQ ID NO: 15464 - DNA, 184 bp, Homo sapiens
tcatgaagtttgtggatggcctgatgatccatagcggagaccctgttaactactacgttgacactgctgtgcgccacgtgtttgctcaagacaagggtgtgcctgggcaatcaagggtgaaggatcaatgctggcccctggggaccccaacctgggtaagaattggaccctaaggaaggccccc

SEQ ID NO: 15465 - DNA, 134 bp, Homo sapiens
tagaagaatattactgtgtttattcttaggtaaagagaggtaccaagccaaacactgaatactttagaaaatttctagatagacacagcttagaaatggagcttagcttttttttttttttttataataccccc

SEQ ID NO: 15466 - DNA, 302 bp, Homo sapiens
gggctatttttggagcattacaagatatacttgggagccgttctttttcaaaggaatattataatcagacgggccgtatacctgattggtgttctctcaataacccacctcttgggaatgatgtttgatgtcgggaaaactcaaccacctctgatgaagagagcattttccactgagagatagaagtttgattaaaattcaacctcgcttcatatcaaatatttaaccacttataggcaaattgtacaaggtatgtagggtgttttgttatagaggactatagtgggagtgaaagcatactg

SEQ ID NO: 15467 - DNA, 223 bp, Homo sapiens
tcagagttcaagacaagcctgggcacacagtgagatcccacctctccaaaaaataaaaaacttagctaggcattgtggcacatgcctgtagtcctagctacttgggaagctgaggtaggaggatctcctgagcccagaagttgaagggctacagtgagctatgattgcaccactgcattccagtcttgataatagagtgaatctctatttctaaaaaaaaaaa

SEQ ID NO: 15468 - DNA, 301 bp, Homo sapiens
ctgggcacaatccgctgaagagctcaggaattgaaattgggctttccagggaatgaagaagctctcctacatacgcattgctgataccaatatcaccagcattcctcaaggtcttcctccttcccttacggaattacatcttgatggcaacaaaatcagcagagttgatgcagctagcctgaaaggacttaataattttggctaagttgggattgagtttcaacagcatctcttgctgttgacaatggctctcttgccaacacggctcatcttgagggagcttcgcttggacaacaacaag

SEQ ID NO: 15469 - DNA, 260 bp, Homo sapiens
aggcttttgtcctggcttggagactaaagagctgtgtggccttcagcacatcttactgtatctcagttgtccactctaatgtgaaagtgtttggaatagatgatctctgaagttctgtcagattctgtggttctattatgaaacaaaagcccttccagtcactgagattaataaagtcttaaacagcgccaaattggggcggagttaggtcatggtgttcaagggaaggctttttaattggagggaccaagattcttgat

SEQ ID NO: 15470 - DNA, 236 bp, Homo sapiens
gtatgagcagaatgagacaatcagttaaatcagaaatgagaagtattataatgtaaaggccttgcttttgctgtagcaataaaatgaccaagtgcaatgacttgatttaataaaatcatattttaaaagttgctgctatgaatatttttggctataaaattttaccctgacttgctttcaataactgttacggaatgcagttgatgttgtaacctcacattccacaaaaaaaaaaa

SEQ ID NO: 15471 - DNA, 306 bp, Homo sapiens
gggggcgggaaaaagcttactggctctgaagaccacagtgcaagcaatgaggaatacagcctgtgggtttatcagtgcaacagcctggaacaagcacaagccatttgcaaggttttatccaccgcttttgactctgtattaacatcttagaaaccctgaatcctgcaatcaagtaggaggtcaacttcatctgaaagttcagctgttttcaaactgcaattctgaaatgttatgcacataatgaaggtatcccctgctctagattttctggaggaaatggattgtgtaaaatgctcgatcacttgt

SEQ ID NO: 15472 - DNA, 299 bp, Homo sapiens
catagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggagtccattcccagaagttgcagaatcagttcagcaagaactaggatcttacagagcacaggaggtgaggtcaaacgcacttaaagacattatggtcth

SEQ ID NO: 15473 - DNA, 233 bp, Homo sapiens
gatactcctcatatcacaacattacacatacatttccatacttttcaacattctaccttctctacatactacatcatttactaaatcatctatactactcaacttaatcctctctcttcttcactcttacaccactacacaatctataactctttaatcttttccttctcattcactctctatataatcaatttcaaaaccaacaaaaaatcttccccccccatttttttcca

SEQ ID NO: 15474 - DNA, 306 bp, Homo sapiens
gcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttttttt

SEQ ID NO: 15475 - DNA, 348 bp, Homo sapiens
atgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaaaaaaaaaaaaaaaaaaaaaaaaa

SEQ ID NO: 15476 - DNA, 559 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgcatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgg

SEQ ID NO: 15477 - DNA, 400 bp, Homo sapiens
gagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaacttttcaaaaaaaaaaaaaaaaaaaaaa

SEQ ID NO: 15478 - DNA, 149 bp, Homo sapiens
caaagaccaagatatagtcaagaagatcatccaagaattgacctctgttgaaaacagcgtgacagcggacacattggccatgctaacctcaccttcgagcagcttcgtagcttgatggaaagattaccgggaaagaaagtgggagcaga

SEQ ID NO: 15479 - DNA, 175 bp, Homo sapiens
gcaaaatagatattcaaactactcagagcagtccctacaagataggaggtactatagcactagttttactaacgctggcaaataaaattactctaaggaggaacttaaagtacttagtaacttagtgataaggatggtgaaatgtaaaattttatttatacgactatacaattta

SEQ ID NO: 15480 - DNA, 308 bp, Homo sapiens
gacagaagcaggggcagccgggagtggtggcttacctgtaatcccagtactttgtgaggccaaggcgggtggatcacttgagatcaggcgtttgagaccatcctagcctggccaatatgatgaaagcccatctctactaacaatacaaaaaaattagctgggtgtggtggcgcatgcctgtcatcccagccacttgcgaggctgaggcaggagagtcgcttgaacccaggaagttgaggttgcagtgagcccaaatcatgccactgcactccagcctgggcgacagagcaagactgtctaaaaaaaaa

SEQ ID NO: 15481 - DNA, 124 bp, Homo sapiens
cggtgaaatactgggaaatgcaacctgcaacacgttcgttgtgttttgagcagaatgagtgttcagcttggggaactttgggaatgtaatacttagtaattgggtaatgtccatttgctatacg

SEQ ID NO: 15482 - DNA, 197 bp, Homo sapiens
aaacgtcttatgccaagagtgacacctactatgggtgcatgtacccagtctttctcttcataatgataggatttaagggacagatcaaacatcaacagtagaaaatgtattttgctaccatccttgctttctagagaactgatggcctgtctttatgagcaacatcttttttgaaggcaaaattggctgtcatcgaa

SEQ ID NO: 15483 - DNA, 187 bp, Homo sapiens
  misc_feature 87: n = A,T,C or G
aagtatataatcatgtttgggttctttttaccccaagtttaaaaaactgacatctatccttttttttaggctatctgaatgtatganaaaagagtagaagttattttacagcatatattttgctgtaaaaggaactacaatttaaccaattaaattatttaccagtgggattcaatttatataagca

SEQ ID NO: 15484 - DNA, 158 bp, Homo sapiens
ttgaaagatttgggatttttcccacctcatcatagatgggaaacttttgttttcagtgcacacaatgttggagctgtaatagtaagagctttcttacaaagctttgtattactgcgcgggtttggttttgacgttgttgtttatttgattttgatttt

SEQ ID NO: 15485 - DNA, 201 bp, Homo sapiens
attttcgttggtggtgttcagttgtggcggttgctggtcagtaacagccaagatgctgcggaatctgctggctcttcgtcagattgggcagaggacgataagcacttcttcccgcaggcattttaaaaataaagttccggagaagcaaaaaccttttccaggaggatgatgaaatgccctgtatcccaagggtggggtagc

SEQ ID NO: 15486 - DNA, 104 bp, Homo sapiens
agcacatagtaaactaacctttataataagtgcagactatttatggtgctcttagaaacagtggtttggtaaaattttgacatgagatgttttgctatttcatt

SEQ ID NO: 15487 - DNA, 141 bp, Homo sapiens
tgtggacagtggtggccgcgctgtgcctgctcgtgttgcctacatgtccctggctgttgaggcgctgcttcagcctgcacccctcccttgtctcatagatgctccttttgaccctttcaaataaatattggggggcgagca

SEQ ID NO: 15488 - DNA, 158 bp, Homo sapiens
cgcggtgttgtgctgtgggaagggagaaggatttgtaaaccccggagcgaggttctgcttacccgagggccgctgctgtgcggagaaccccggggtgaaggccaccgtcataatgtctaaccaggggggcaaaacctcgacctaaggacttgggggaw

SEQ ID NO: 15489 - DNA, 177 bp, Homo sapiens
ggaacggagcaatttacagcaatgagggatttatacatgaaaaatggacaaggatttgcattagtttattccatcacagcacagtccacatttaacgatttacaagacctgagagaaccagattcttcggaggtaaagacaacttaatgatggttccagtgaattcttgttgggaaa

SEQ ID NO: 15490 - DNA, 145 bp, Homo sapiens
cggacgaatcggcgtttgcgaggctggcatagatttggctgtctccgctcatagctgcttttgtgcgcgaaagatgccgggtctggttgactcaaaccctgccccgcctgagtctcaggagaaggagccgctaaagcccttctgc

SEQ ID NO: 15491 - DNA, 198 bp, Homo sapiens
cggagagacctggctgctgtgtcccgcggcttgcgctccgtagtggactccgcgggccttcggcagatgcaggccttgggtagtctcctttctggactgagaagagaagaattggagaagcccctcttcccgttgaatctagaaaactgtatctgaaggtgttcccaccctaaggcgcttgcatttagaggtgctaag

SEQ ID NO: 15492 - DNA, 212 bp, Homo sapiens
gaaagtttccttaaagttgtgagcatgtttggtaagggcacaaatctcttgatagttcctgaaggtgccaccattatcatttgacagagctttttattcccattgaagcacatgacttagaggggggttacttgagaagaattaggaatttggggaaaacttaaaggagttactgtcttatgactaggtaaggatgtttcacagtggggtaa

SEQ ID NO: 15493 - DNA, 185 bp, Homo sapiens
gcaaggtgttgctaagatgaaagttcatagccctgaatgcctacatcaaaaagtctgcgaaaactttctaagtctttctaaacaatctaaggtcacaccacaagggactagaggaacaaggcacaaacctaattcaaaccccgcaggaggaaggggattacccaggttcagggcggacctttttt

SEQ ID NO: 15494 - DNA, 206 bp, Homo sapiens
acaaagccaagacgttccatggtatttgtgcaaaagagatgaagacttctcaatatgcttattttgctttgcataattggctctttttaagagcccaagaaagtgtttctaaaattgcttgcactgcccaatcccagtaatgcttctgtcttacaagaacacaaacaacaggcccagattgtcctaatctccctactctcttggcm

SEQ ID NO: 15495 - DNA, 199 bp, Homo sapiens
aaatttagcgtctactacctccttagcccagtgacagctaggatgtgcattctccagccatcaggagactgagtcaagttgttccttaagtcagaacagcagactcagctctgacaatctgattcggatgacagtgttcaaggatcggaatcccgtcgattagactggacacacttgtggcaagtgaatttgcctctat

SEQ ID NO: 15496 - DNA, 291 bp, Homo sapiens
gaactgatttacttgtggcattttaatacatgccaaaacagtacaagatacctgagaaactctgcaacctgtgctcttcttcttcataaataactgagtccacataatggtgatactgggatctgagagaatttgtcttaggccttatgctgcaagtactgctcatcactactaagagacccccttttaatgcggaggtgccatttttatattgcattccagaaagtaatcaatttgatgcgtgactaggaaaatttagaggagtttttaatcacaagacttcacctgacg

SEQ ID NO: 15497 - DNA, 135 bp, Homo sapiens
aacatgaagtaaagaataacgttgaggcctttactgttagctagtctaatactcctgcgaggcaggaatatatctatctagtaagaattttaatgtatcattattcctttatgtcttcaagcaggccttctgata

SEQ ID NO: 15498 - DNA, 293 bp, Homo sapiens
cctctgaccttacttaatatcactttccatagtgggattatatttcaaagaagctgtgtctcagctcagcttggggtccacactcaagacctgcctcaaaggcaatgttcagcccttagggtttactctgagaagtatttacatgtctgtacccatgtctgacccctctaaaccagcgaatcctgagctttactctcaataatagataaatatataggccgagcgtggtgactcagacttgtaataccggcactctggggaggttgaggcaggctgatcacttgaggtcagga

SEQ ID NO: 15499 - DNA, 291 bp, Homo sapiens
gctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaccgttctcagaactgtttgtttcaattggccatttaagtttagtagtaaaagactggttaatgataacagtgcatcgtaaaaccttcagaaggaaaggagactgttttgtggaccactctc

SEQ ID NO: 15500 - DNA, 291 bp, Homo sapiens
aaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataggagaaaatagatacacacattcttttttctcagtcaacacattgattgaacactctggcaaagatgctgtggtggatgaggttggagttcgaaagaagaagcaagcgctggcctggccttgaaaga

SEQ ID NO: 15501 - DNA, 289 bp, Homo sapiens
gagactgaatgtgaagtcaagtctgagcacaagaagataatgcacgatgagattgcctaccattttataggatatttactatgtatttatacgttaagacctctatgaaatgtatcagagaatgtctttgtaactgtttaattcaatctgtaataaaaatctaactaactaactcatttatttctattaaaaaggtattgtcctttaggcggggaattggaatccttgctgcactgttgcagtcattctgaaaggacctttccttgtacttacctttcaacatgctcaa

SEQ ID NO: 15502 - DNA, 282 bp, Homo sapiens
tcccatcttgcaagatggcgggtgaaaaagttgagaagccagatactaaagagaagaaacccgaagccaagaaggttgatgctggtggcaaggtgaaaaaggggtaacctcaaagctaaaaagcccaagaaggggaagccccattgcagccgcaaccctgtccttgtcagaggaatttggcaggtatttccgatctgccatgtatttcagaaaggtcatgtacaagggggagtacttcagcgcttaaatccaaggttggaaaggaaaaggaggaggaggttt

SEQ ID NO: 15503 - DNA, 273 bp, Homo sapiens
caaaatggctggtaagcaggccgtttcagcatcaggcaagtggcttgatggtattcgaaaatggtattacaatgctgcaggattcaataaactggggttaatgcgagatgatacaatatacgaggatgaagatgtaaaagaagccataagaagactttctgagaaccctttataatgacaggatgttcgcattaagagggcacttgacctggacttgaagcatcagatcttgtctcaagagcagtggacccatatgtaaggggaaaatttcta

SEQ ID NO: 15504 - DNA, 205 bp, Homo sapiens
aaatgatggcgactggaacgcagagtctcaagcgcggttcggtcagtccgtgaaggggcttctcacggagaaggtgaccacctgtggtactgacgtaatcgcgctcaccaagcaggtgctgaaaggctcccggagcttccgagctgctaggtcaggcagctcgaaacatggtactccaggaggatgccatccttgcactaaggag

SEQ ID NO: 15505 - DNA, 223 bp, Homo sapiens
agaggcgcgcgtcagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactgtgctgttccgtactttactgcctgaataaagagccctaagtttgtactaagg

SEQ ID NO: 15506 - DNA, 178 bp, Homo sapiens
  misc_feature 18, 22: n = A,T,C or G
ttgcttgcacggtgcatnacangggtttctcaccatcgcaggtcactaagtagtagtcactccagaagagacagctgggaccttctttgcagtacaatttgaaattcctgatgtattttgcttattattttggctcaattctcataataaaggggggtttttacttgcattggcaggg

SEQ ID NO: 15507 - DNA, 131 bp, Homo sapiens
  misc_feature 24, 30: n = A,T,C or G
aagagaagaaaataagaaccaggncaaaanctgactagatgctgccaaatcaaacccaaggtctcctaaccgaaccttaatggggctgcttctcttcccaggggcaagttaggttaaggagtcttaatttc

SEQ ID NO: 15508 - DNA, 122 bp, Homo sapiens
  misc_feature 29: n = A,T,C or G
tcttgacagatatcgatctttattctgtngaagtagttttaggaacatcctatgagttttcttagaatgtataaagggtgtagtccattctacttcaaaggaaaacttgaccccaaaccttt

SEQ ID NO: 15509 - DNA, 143 bp, Homo sapiens
  misc_feature 21, 26: n = A,T,C or G
caagatcaccctgggagtttnctganaggtttctcataaatgagggctgcacattgcctgttctgcttcgaagtattcaatacccgctcagtattttaaatggaggggattcctaaggttttgggtttggggtactataggga

SEQ ID NO: 15510 - DNA, 138 bp, Homo sapiens
  misc_feature 18, 24: n = A,T,C or G
ttttgaacgatattgaancaaagncttaattagtagggggttccaatttggcataaaatgtaggtttgttaatgtaaattttttttttggttaaggattttgattgattattaggggtttaaaaggaaatttttaaaa

SEQ ID NO: 15511 - DNA, 121 bp, Homo sapiens
  misc_feature 24, 30: n = A,T,C or G
ggaatgcagcatttaaatcagaantctgcncaatgcttttatctagaggcgtgttgccatttttgtcttatatgaaatttctgtcccaaggaaaggcagggttacatcttttttttttttt

SEQ ID NO: 15512 - DNA, 161 bp, Homo sapiens
  misc_feature 22: n = A,T,C or G
cgggcggagtggagacgtgtgnagctgtcgaggactcgcgggtctgcagtgcacctatgatatgtgttttagaaatagccgttaaactttgggttgaatgaagaatgtctctcaatccacctatatttctcaaacggaggaaaggaaataggtcaaaattt

SEQ ID NO: 15513 - DNA, 166 bp, Homo sapiens
  misc_feature 20, 25: n = A,T,C or G
aaatcagcagagttgatgcngctancctgaaaggactgaataatttggctaagttgggatagagttcaacagcatctctgctgttgacaatggctctcttgccaacacggctcatctgagggagcttcactttggcaacaaccagcttaccagaggaccctggggg

SEQ ID NO: 15514 - DNA, 237 bp, Homo sapiens
ttacagaacatgatctataggacttctgtttggattattcatttaaatgactacatttaacatgaattacaagaacggtgttctagccagaaagatgacttgattggctaagataaaaatcttggggggaatagtgtattctcctattacctcatggtctggtatatatacaatgcaaccacacataccacacacacacacacatgcattacacacactacacacacatacacacac

SEQ ID NO: 15515 - DNA, 239 bp, Homo sapiens
actcgataccttcacagcttctattggacatattttctttttaggaatgaagggaaaattctcccatttttgagccattcttttgtcaattctacaaaattgcatgtaactttataaatatttttcaaggatatagttttgtaaatatttaatattccgctaatttgattttgaattgtaaatgtcaagtattctgtttttcgggggctttatgttttattatacttggtaaaaagggc

SEQ ID NO: 15516 - DNA, 164 bp, Homo sapiens
accctctgaaaactgcagcttccttctcaccttgagggataatcctaggaaaactcacaaaatgttgtgatgcttttgttagggtaccctggaaacttgttttccaggtgtaaaactttggttggatttatatggaaaggaggtaggggggtggggttttgccm

SEQ ID NO: 15517 - DNA, 241 bp, Homo sapiens
gggaggggggagaccgaccgacctattttgttggtctcgatcgtgtgaaaacatgaggaagtgggcacttacatgccaggaggagagctctcactagggggttgaccatgctggcactctgatctcagacttccagcctccagatatgtgagattataaatttgtgttttgggccagatacggtggctcaggcctgtaatcccagcactttgggaggccaagacaggtggatcaccagagg

SEQ ID NO: 15518 - DNA, 247 bp, Homo sapiens
gaagctgggaggcggaggttgcagtgagccgagattgcatcactgcactccagcctgggtgacagagtgatactctgtcaaacaacaacaacaacaaccaccaccaccaccaccactagcaacacccaacaaactggcaacaacaaaaaccagtcaaccaaggggggagaatcaactgaaatgtccgttcaatagtggcatagacatacagtggattattctaccttgaaaagggaggtaatcctgg

SEQ ID NO: 15519 - DNA, 241 bp, Homo sapiens
agaacatgcacaatagtatgtttttattactggtttaatggagtaatggtacttttattctttcttgatagaaacctgcttacatttaaccaagcttctattatgcctttttctaacacagactttcttcactgtctttcatttaaaaggaaattaatgctctctacgatatatatttcccgtagtgctgacaggacccactctttcattgaaaggtgatgaaaatcaaataaagaatctc

SEQ ID NO: 15520 - DNA, 156 bp, Homo sapiens
ccaagcatttcatgaaaaagctgcttcttattaatcatacaaactctcaccatgatgtgaagagtttcacaaatccttcaaaataaaaagtaatgacttagaaaaaaaaaaaaaaaaaaaaaaaaaaaaaaaaaaaaaaaaaaaaaaaaaaaaaac

SEQ ID NO: 15521 - DNA, 241 bp, Homo sapiens
aaacagttattttttgtaacaatttttaaactattaggcattatacattacaaaatcttttgttcttttaaaatagtaaaatgtgcccagagtttagtgctgaagtattctgcagtgatgttgaaaaatgtgaaacaccttttatttggcatgttgtctaaatgctgcctgaccccgcagttcttgcagttggtgcatcatctgaatgctgtctaaccctgcagtttccagaaacatgaga

SEQ ID NO: 15522 - DNA, 239 bp, Homo sapiens
aaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctctggctggtttttgctgcggatggtgagatcagagcag

SEQ ID NO: 15523 - DNA, 194 bp, Homo sapiens
attcctgaagctgacagcattcgggccgagatgtctcgctccgtggccttagctgtgctcgcgctactctctctttctggcctggaggctatccagcgtactccaaagattcaggtttactcacgtcatcccgcagagaatggaaagtcaaatttcccgaattgctatgtgtctggggttcctccctcccgcat

SEQ ID NO: 15524 - DNA, 124 bp, Homo sapiens
ttggctcagacctggaatccacaaaaagccaacccagctcattttaacaaaggagctccgatgtgaggggcaaggctgccccctgccccagggctcttcagatagcatctgcatgtgaacacca

SEQ ID NO: 15525 - DNA, 114 bp, Homo sapiens
ttttttaaacccttgataaatcggcttacgcttacgtcacaggtccatgatcctcaacatggtgggaacatttatcacacgtctgtctgggtttgtaaatatagattcttaccg

SEQ ID NO: 15526 - DNA, 237 bp, Homo sapiens
cagaagatgaaggtaagtagaaaccgttgatggggctgtgaaaccagagttaaaacctctttggagcttctgaggtctcaactggaaccagcgggcacagttggcaccaccatcatgccatcacaccctgttcccaatgggaccatcatagtgctcccatcaaatgtcatcaactcctcccaagccgagaaacccgcaccccaccatccaggggcaggatagccttaagaacatctm

SEQ ID NO: 15527 - DNA, 178 bp, Homo sapiens
ccatctctgtctcaactctacgtgtactgagctgcaactccttacttccccactgaaaataagaatctgattataaactctcctttctcaaatatttgctattagaggctgactggattacttaaatacgtcaatccctcggaggttgagagagcacataaagacctctcgaaccctc

SEQ ID NO: 15528 - DNA, 210 bp, Homo sapiens
tggagtgagccaaaggttcgaaaggtgtttcagcttcttcgccttcgtcaaatcttcaatgggaacctttgtgaagctcaacaaggcttcgattaaccatgctgaggattgttagagccatatattgcatgggggtaccccattctgaagtcagtaaatggactgatctccaagcgtgggttatggcaaaatcaataaggaggcgaattt

SEQ ID NO: 15529 - DNA, 165 bp, Homo sapiens
gcaaagacttctgtattattttccgaaatacaagttggggtatcctatttgtcttgaaatgctcaaggaccagcaagtgtcctcttgaggggggggacctgggaaccctacaaagtttaactcttgtgtcgtgcttaaaaattgatttaggggggtggggcaaaa

SEQ ID NO: 15530 - DNA, 130 bp, Homo sapiens
gggatgcaggcaggtaatatattgcagcactggaagaatagcttttcagagggagagacagccagccagagagaaaacctaactctttttgactagaaagttgcaggattgtgttcatcaggtgctttcb

SEQ ID NO: 15531 - DNA, 105 bp, Homo sapiens
agattccatatacaaacgaagaagacatgagtttagagaattttcctcctttaatttttttttaacagaagggtttcagagttgaggacctagattacgctaccc

SEQ ID NO: 15532 - DNA, 112 bp, Homo sapiens
aggcgaacggcgcgtccacgtccacagaccacagtaccgtccggttccggagcgcagtcacaaacgttaagtcgacgcactcagttcacagtaccgtttgcgtaatccaaag

SEQ ID NO: 15533 - DNA, 107 bp, Homo sapiens
atcatgtgtatgggtctgtctagggagggagtaagagcctcatctctacagttcgacaagagactctccatggcgtagactagtccctgttcttcaaggactggtca

SEQ ID NO: 15534 - DNA, 186 bp, Homo sapiens
  misc_feature 21, 22: n = A,T,C or G
ctctctcaatctgctttattnnactttttgataaatctgtgcagaactatttagcattgaatagatatggttagctgaattctgttttctcaggccatttattattcacccagattacattctgaagaggctttaactcaatatcttaatacattttggctatcaatataagcattatatacaccb

SEQ ID NO: 15535 - DNA, 205 bp, Homo sapiens
agcgcaggggcttctgctgagggggcaggcggacttgaggaaaccccagataagtttttttctcttgaaagatagagattaatacaactacttaaaaagatatagtcaatagggttactgaggtattgcttagcgcgtaaggttttaacgcgaattttcataggctctaagcgttttcagagagaaatatgaagagcttagagag

SEQ ID NO: 15536 - DNA, 157 bp, Homo sapiens
tagctttgtctaatgtggcagccaattttcagagtagcccaaaagttaatgtttaactttacctagaggtatatgttgtataaataatagcctaattttagtggggaagtttgcggtcatatttttgcggatttgctttagactctttcgggaattc

SEQ ID NO: 15537 - DNA, 173 bp, Homo sapiens
  misc_feature 15: n = A,T,C or G
catggtgttgacagncttgtcccaacatgcggattcattctttaaactcgttgacgttatacaaaggtcccgccccgcaggtgttgtatgtggtgcacagagggtgaggtttggggcatcgggcactgtgtgcattgctaagggggcatagtgaggcaatgttgggttttact

SEQ ID NO: 15538 - DNA, 183 bp, Homo sapiens
gcaactatctgggagacctaaaacatatttagttttagtgcctagagattttcactcctctaacatctctggatacagtgtccctggtcaacatgaaggaggttacagaaggatgcttttttgatactgggcccctaaaggatttacttgtgctaaggaataaaattcctattggtcaaaaaa

SEQ ID NO: 15539 - DNA, 195 bp, Homo sapiens
taagactactttttatacgacttcgatattcgacttggtgcctggaggcttgagcaaactcggaaaatgaattaggttgtttgcagtcttcagttgtgttcttatgcttcagtgtcacatttcatttcatttgaagctaaaattttcagtaaagctgaaataaacttcttgtcattgtctgcctttggataattt

SEQ ID NO: 15540 - DNA, 137 bp, Homo sapiens
taccagcttagacatctgtcttgtttgcttgatttagtgtgctctgattattgttatttcagagaacaagtcatcattcagagcaatttgctgaggcattcctttttggataaggggtcccggttaatctgcattaa

SEQ ID NO: 15541 - DNA, 207 bp, Homo sapiens
gaatttaaattcatatggaaccaaaaagcacccaaactataaaaaccctagaagaaaatctgacaataccagtcaggatgtagccatgggggaagggattttcatgacaaaaatccgctaaaaggcaatttgcaacaaaaagcaaaggcaattcctaagcaaaaattaacaaaggctgcaggcatcatactacttggcttcaaacth

SEQ ID NO: 15542 - DNA, 231 bp, Homo sapiens
aactatgtgtctcccgaaattagctctgctactttgcacaagtctcctttcctaagatcccgcttctcatctgttcaatggggatatgaacatctacaagtttatggtaaagtttaaaagcacatttgtctgatactaagggcccataaacaatcgttactttcattaccccagttggcaatttgagcagggcatgacaaggagtttgggtgacacggcgataaagtaacg

SEQ ID NO: 15543 - DNA, 145 bp, Homo sapiens
taagctagatactggaacctaactgcaatgtggatgttttacccacatgacttattaatgcataaaagagaatttccaagtttaaagtaattggcctacaataaaaaggaattttggcctggccaattttcaagatcaatctttt

SEQ ID NO: 15544 - DNA, 290 bp, Homo sapiens
tccgaggtcattatttctggatgctaagtccattcagtccaccatctccagctcgcagaattactgaaggttggggtattccttcccccattgatactgtttttactaggtgcaactgtgaaggaaaaactttcttctttaaggattctcagtactggcgttttaccaatgatataaaagatgcagggtaccccacaccaattttcaaaggattttgaggactaactctgacacatagtgtgcagcgctttcaacagctatatataagagctcgcctgaatctgtgtatt

SEQ ID NO: 15545 - DNA, 150 bp, Homo sapiens
aagctgacagcattcgggccgagatgtctcgctccgtggccttagctgtgctcgcgctactctctctttctggcctggaggctatccagcgtacttccaaagattcagggttacttacgtcattcagcagagaattgaaagtcaaatttc

SEQ ID NO: 15546 - DNA, 116 bp, Homo sapiens
tccttgaacctggaaagcgaagtttgcagtgagccgagattgtgacactgtactccagcctgggcaacgcaccgcgactctgtctcaaaaaaaaaaaaaggggttttttttacaac

SEQ ID NO: 15547 - DNA, 163 bp, Homo sapiens
gacctattaagttcaatgtatgggacacagccggccaggagaaattcggtggactgagagatggctattatatccaagcccagcgtgccatcataatgtttgatgtaacatcgggggttacttacaagaatgtgcctaactggcatagagatctggtacgagt

SEQ ID NO: 15548 - DNA, 203 bp, Homo sapiens
aactgtaaaattttccagacaccagagccccacagattgcagactccaccaatttcctgactactacgtagtcaaataccaggttcacctatttacaaaaccagctctttcttccatgttagttcaaaacatagtttctggtggttgataccaatgctccatcccagtggggagctatggatgacacaacttatttctaaaag

SEQ ID NO: 15549 - DNA, 242 bp, Homo sapiens
agctgtgaaaggaggagctctacggtgactttgaagacttggaaacaggggacatgcacaagggaaaatcgggccccgacactcagaatgaagatatagagaaacaaggaagaaattgaccccgacgaagaagaaagtgtccaagaaaaagcattttgataagaagagaaaattgaaggagatgtttgatgcggtatatgatgaaggagagagcacatattttgtatgatctctaaaggaga

SEQ ID NO: 15550 - DNA, 263 bp, Homo sapiens
gatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatggtatcatcattagtgatctgtgttgtagagcatgagggtgtatgtcttcagacctctgcaagtta

SEQ ID NO: 15551 - DNA, 237 bp, Homo sapiens
aggcagccagcgcaggggcttctgctgagggggcaggcggagttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcacaaaaaaaaaaaaaaaaaaaaaaaaa

SEQ ID NO: 15552 - DNA, 310 bp, Homo sapiens
actgatttcccatcagatatcgctaacaagtctctctcagagaccactgcaacaatgctctggaagtccaagggcaggagaagaagagcatcccaccctactgctgaatcttctagtgagcagggggctagtgaagccgacattgacagtgatagtggttactgcagtcccaaacacagcaacaaccagccttgcagcaggggctttgagaaatcctgattctcgggaccatagaatcatgtgggagtcatctcatagtgttgcaggtgcgtgttaaattggggcccactcgtaacttgcccacgcaact

SEQ ID NO: 15553 - DNA, 253 bp, Homo sapiens
tattttactgtcactggaggctctgtgggctgtcatagttaattgaccataattagcaatatacttttaaagtgggaaagctgaatgacacttttaaggcaatgaacattatcaaaacaaaatgtataatttcttaatttgaataataaattaagcggttaaatgctatttgtagtcttgatatccagaaataaaataattaggggtgggcttttttattttagggtgttttatgttgattgttctctaatct

SEQ ID NO: 15554 - DNA, 209 bp, Homo sapiens
cagataacaatttctttttttcttttttgagatggagtcttgctctgtcacccaggctggagtgcagtggcatgatcttaggtcatggcaccctcttccttccaggttaagggaattttcctccctaagcctcctgtaataggtgggcctaaagccccgaaccaccacacttgtggtaatttttgtatttgttgtagagacagagtttc

SEQ ID NO: 15555 - DNA, 331 bp, Homo sapiens
tggaattcgcgaagtgccaaagccttagacaagcgccaagcccatctttgtgtgcttgcatcccactgtgatgaggccatgtatgtcaaggttgttgaggccctttgtgcttaacacccaaattaaccttattaaggttgatgacaacacagagactaggagagatgtgggagggcctcttgtaaaaaattgacaaagagggggagaacccccctataagtgggtttgtttcagatgtgtagtagataagggcttttgcacagagtctcagggcacgggtgtcattttaagagtatttcacatccacgagatgtagagatatatcttttgc

SEQ ID NO: 15556 - DNA, 221 bp, Homo sapiens
aatccgtgcctcttaatttaccagaaagtctacgtgtaattcatcttcaggtcaaccacctaggtttaattacaggtgacaaaatctgcaagggttattgaacacgggttcattccgggcccgatttgagggattaggcttgaggggaattcaattgtgccctggggagaatatcacacacagttattttctttaaaaagagtttacccagggggaaaaat

SEQ ID NO: 15557 - DNA, 215 bp, Homo sapiens
acttcgctcgtactcgtgcgcctcgcttcgcttttcctccgcaaccatgtctgacaaacccgatatggctgaggtcgagaaattcgataagtcggaacttaaggagacagaaacggaagagaaaaatcccactgccccttccaaggaacgattgaacaagagaagcaagcaggcgaatcgtaatgaggcgtgcgcccccaatatgcactcttaca

SEQ ID NO: 15558 - DNA, 292 bp, Homo sapiens
atcctctgcacaaacaaaatctgaagggttccatgacatcttgccaaagtcctcagacaactttaggcaataagggaaggaggaaacctgtttcttctcatttgggtatgttaaccttacttaggcttggagatgaatacaacttccactctttggtaactcaactctctttgggccctcagtcctccaaattttttctgcttctgacttgaacccccgtgaaagggagtgacacccccaaattgaaagagactttcaaaagggcactctgatgtatatctcagatgttaaa

SEQ ID NO: 15559 - DNA, 223 bp, Homo sapiens
tcttttagggggcttttaattggtgatctgaaatctttggagaagctgttcttttcagggcctaggggctcttgactgtcggctgcgcactgtgtaccccgagcaacattcttagggtgtgctttcgcccttggctaaactctctctgacctcaaatctttcatatagagagtctcgggagaaagttgcaggtaattttaactctctaggggggacaaagtaa

SEQ ID NO: 15560 - DNA, 183 bp, Homo sapiens
attttaattagggaacaaagcttagcaggagaggagagccagagaagtgacaaggaagctacaggttacaacagatttgtgaacttagccaaggacaattgttgcaggggcttgcttcttcaaagagaggcaatcttttgacaaatactcatgttgtatgtggcaaaaaaactcgcggggcts

SEQ ID NO: 15561 - DNA, 176 bp, Homo sapiens
ggacacacacactgatcctcttattgtctccccaaaggcaacccacagatataacaacaatatagcggaaaatcttctcagaaattaggaactatgacggtatcccatctgtctacctcaaagttagtgttagagtgagtgccacagagccccgcaccaaataagagggggactgt

SEQ ID NO: 15562 - DNA, 203 bp, Homo sapiens
gagcatttgaataatagggacttatatagttcacctatccaggaaaattgaaaaatgatgccttcagaataatattgattagatacaaatttggttaattttctaaaaagttataaaaccggtaacctttgggtttcttgctttctctaggacggaaatttacaagttacattggaccttcacagtttctagactttgatcag

SEQ ID NO: 15563 - DNA, 179 bp, Homo sapiens
atgaatatttttatgaagtttaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgg

SEQ ID NO: 15564 - DNA, 205 bp, Homo sapiens
gccaggggatttcgaagtttgcaacctgtataggataactgatggcaatattaagacagacgcctgcttttgcaaataacttacaagactgtaaattccaaagatctgaatgggagctttcctgatgttgggtatctagggcttaggcctattagattgatttacctttggaattgtgctccaaatgcctactgaagcttaacca

SEQ ID NO: 15565 - DNA, 303 bp, Homo sapiens
gagacctagcattaaaattccaggctgggcgcagtagctcaccctgtaatcctagcacttttggaggccaaggtgggtggatcgcctgaggtcaggagttcgagaccagcctggccaacgtggcgaaccccgtctctactaaaaatacaggaattgtcgggcttggtggctggtgcctgtggtccggctactcgggaggctgacgaggagatttgcttaacctggggagacagaggttgcagtgagccgagatcgcgcactcactccacctggcaaagagcaaactctgtccaaaaaaaaaaa

SEQ ID NO: 15566 - DNA, 509 bp, Homo sapiens
  misc_feature 276: n = A,T,C or G
agcaaaatagatattcaaactactcagagcagtccctacaagataggaggtactatagcactagttttactaacgctggcaaataaaattactctaaggaagaaattaaagtacttagtaacttagtgataaggatggtgaaatgtaaaattttatttataagactatacaatttaaagttgtttgccaaatgtaataagacaagtagaatatattctcttcaatgtttttataatttgacactaagaagattttattatatatgcaattgctggnggttagatatatgatacttaaaattttctaattatctaattatctttatttttaacaggataaaatattaatcaacttaaaggacatttctaaggagattgaattctaaaagattaatcttttacgacaattctaaaagattaatcttttagacaatctaaaagattaattgaatctaaaagattaatcaacttaaaggacatttctaaggagatggaaaaagcatatatcta

SEQ ID NO: 15567 - DNA, 530 bp, Homo sapiens
  misc_feature 18, 51, 63, 128: n = A,T,C or G
tcgagcagaatgagtgtncagctgtgggaactttggaatgtaataattagnaattggtaatgnccatttaatataagattcaaaaatccctacatttggaatacttgaactctattaataatggtagnattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagaactgtactgtaaatggaatgcttgacttacaaaatttgtgctctttcatttgctggtagaaaaacagaatacaaagacggtatgtgaagaggcatacactattctaattcttagtacctgggagaccggatattttaaacatcctaaaggatg

SEQ ID NO: 15568 - DNA, 549 bp, Homo sapiens
  misc_feature 315: n = A,T,C or G
tgttaaacgtcttatgccaagagtgacacctactatgggtgcatgtacccagtctttctcttcataatgataggatttaagggacagatcaaacatcaacagtagaaaatgtattttgctaccatcttgctttctagagaactgatggcctgtctttatgagcaccatctctttgaagacacacttggctgtcttcgaatagagttctgttgggactgggacatttctaactcctctccttagaaagactggttaaggtcatcagctacctgttttgcatgttttgtttcaggactctttctttcatttttgggntctcctaggtgaaatccaggctcatttggtgagtaatatcatctgccagagaccgtttggtatgacatacttctgctgacaccaaactgattggcttcctggcatattatgttccttactatcgggggaacttttcaaggtttagaaatgcctgtgtaagtgtgaatgggaaccatataggggattttaaactataatggttacccggattcaaagacaaatattggacccaat

SEQ ID NO: 15569 - DNA, 560 bp, Homo sapiens
cagccacaatagtaaaacctaaacctttataaataaaaagcagaactattttatggtgctcttagaaacagtggtttggtaaaattttgaaatgagatgttttgctattttcatttttattattttctacttaatatcctctggctgccttattccaacagctctatggtttcctggctgagtcttctcaatattcttaccctcttttgaatttcttcaacatcagaaagactcccatttttttcctggatatttggagcaatccaattttattgaataaattaacacttttaaaaccaactctcccatgttttattgctcatagcatagttcaaaataattccaggttaatagcatttcaggcaataagaagtgcaaaatcagacctcatagataaccaccccttctatccatccttaaggccagcgttgtgagcattttaaatattatttgtatatttttaaaggtactagtaatatggcatcatttagtgatccttttgggaattttttttggggtgcatggttttatccatttggaggttaaatacatatgtgtgg

SEQ ID NO: 15570 - DNA, 195 bp, Homo sapiens
gatctggctggagcagcgagtctgtcgatcccaggccagagacaaggcagacaaaggttcatttgtaaagaagctccttccagcacctcctctcttctccttttgcccaaactcacccagtgagtgtgagcatttaagaaggsatcctcttgccaaggaccaaaagggaaggaggaaaagggcccaaaagccaag

SEQ ID NO: 15571 - DNA, 225 bp, Homo sapiens
acattgttgtgaaactagaaaatcaccataggaatattatttttgaatgaatttaaagagatttaatttgctctatccagtgcagctggagacaactaaagtacgactgccaacaaatcctgcctcaaaccaactctctttatgactcattgctccatgttgagaaactcacatcagcccttgatgactcagttcagtcaattataaaccaggacagataatatt

SEQ ID NO: 15572 - DNA, 283 bp, Homo sapiens
gctataacttacacagcctatggcatgtctgcgttaccgttaaatctgataaaaggcactagaagcgctgcttatgaacgtttggaaaacactgaagacattgaagaggtagaacaacacattcaaacgattaaatcaaaaagcaaagatggtcgacctttgccagcaagggataaacgcgccttaaaacaatttgaggcagggttacgaacacttaaggagagagagaggcatttagcattcattggaaaacagctggtggacaaaattttgttggcgctct

SEQ ID NO: 15573 - DNA, 284 bp, Homo sapiens
cgcggtggcttacgcctgtagtcctagcactttgggaggctgaggcaggtggatctcctggggtggggagttcgagaccagccttaccaacaaggagaaaccccgtctctactaaaaatacaaaataagccaggtgtggtggcacatgcctgtaatcccagctactcgggaggctgaggcaggagaatcacttgaacccaggaggcagaggttgcagtgagccaagatcacaacattgcactccagcctgggcaacaagagtgaaactccttctcagaaaaaca

SEQ ID NO: 15574 - DNA, 420 bp, Homo sapiens
gtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcgatctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatggctca

SEQ ID NO: 15575 - DNA, 368 bp, Homo sapiens
ggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgacaaaaaaaaaaaaaaaaaaaaaaaa

SEQ ID NO: 15576 - DNA, 549 bp, Homo sapiens
gtgaccaggttaaaccgtttttggttttggttgagctcctgaccatcctttatccttgatatttttggaaaaaagattagaggtctagatttcagttcttctctttgctttaactttatggctggccaccattaatatagccagtaatgtaggtattttatggaaatacttattattactgggctttgaaacaaaaacctctgttttataattaagatttgagcccatcaagtgttaaattttctctttcatccctggaaaatatattatgaaacatgtagaaagggtgatctttcttcctttagtcttcaggaaaaaaaaaatccttatatttcagatttgaaacattttatataagcatatatatcataatagtgtttgaattttaagtggtatgagtatcttatgacagtatagcttttaaagctatttaacttagaaaacattcataaatttattcaacaaatatttataggaggtaaacataatttcaaactttgactaaaatggttcgcacctaaatacaaagtatagaaatctgttaaatta

SEQ ID NO: 15577 - DNA, 210 bp, Homo sapiens
ggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacaaaaaaaaaaaaaaaacaaataaa

SEQ ID NO: 15578 - DNA, 231 bp, Homo sapiens
attttttgtagccacaggcttccacggacttcacgtttattggctcaactttcctcactatctgcttcatccgccaactaatatttcactttacatccaaacatcactttggcttcgtagccgccgcctggatactggcattttgtagatgtgggttgactatttctgtatgtctccatctattgatgagggtctcgaaaaaaaaaaaaaaaaagaaaaaaacacacattt

SEQ ID NO: 15579 - DNA, 321 bp, Homo sapiens
ttttgcggcataccgagcgggacggccaatgagtttaatcctttgtgacttccgaccgaagcaagaatcgcaaaaggcatttcaatgcaccttcccacattcgaaggaagattatgtcttcccctctttccaaagagctgagacagaagtacaacgtgcgatccatgcccatccggaaaggatgatgaagttcaggttgtacgtggacactataaaggtcagcaaattggcaaagtagtccaggtttacaggaggacatatgttatctacattgaacgggtgcagcgggaaaaggctaatggcacaactgtccacgttggc

SEQ ID NO: 15580 - DNA, 284 bp, Homo sapiens
aaaattcaacacaccttcatggtaaaagtcactgagcataaagaagggaatttccttaacctaataaaggacattttcaaaatacccgcagctaacaacatattcaatggcaaagactgaacacttttctttaacatcaggaacaagacaaggatgtctgctttgatcactagtgaacattgcaacttctagcagagcaattagcaagacagacaaataagaggcatccaaactggagagggataaattatttctcttttcagattacataattctacatataa

SEQ ID NO: 15581 - DNA, 332 bp, Homo sapiens
gaattggcaccaaagcagcagctgtattgccgcagttctagcttcaccttcacgatgtttcccttggtcaaaagcgcactaaatcgtctccaagttcgaagcattcagcaaacaatggcaaggcagagccaccagtaaacgtacacctgtattttcatgtacaaatacggtaatgctgtattagctagtggagccactttctgtattgttacatggacatatgtagcaacacaggtcggtatagaatggaacctctcccctgttggcagagttaccccataaggactggaggagtcagtcatcatcccagctcgtgtaataatgacttgtgt

SEQ ID NO: 15582 - DNA, 119 bp, Homo sapiens; identical to SEQ ID NO: 15442

SEQ ID NO: 15583 - DNA, 282 bp, Homo sapiens
gcagaactcagtgaaggaagctcccgtgaagaatggaggtgcgaccaccagcagctctagtgatagtgatgacgatggagggaaagagaagatggtcctcgtgacccccagatcttgtgtttcgggagaaaagaaggaaactaagacgtgcgaggggaagaaaaaggaaaacctaattaaaaaatatgtatcctctataattagttatgacaggccatttgtcatgaatttgtcgcaaagacgtaataaaattaactatgtagcacggaaaaaaaaaaaaaa

SEQ ID NO: 15584 - DNA, 243 bp, Homo sapiens
atgaatggcagtgatgattgcacaatgctgtgagtgtatttggcactactaaactggacacttaaaaatggttcagatggtagattttccatgtatttcgacgctgttttttaaattggaggaggaaaaagaatagtgcgtattcgctccctacaggaaagcattgtttctagttttcagcctaacctttgcaaagataccttttcatatacgacgagacacacacatttctttatatatttt

SEQ ID NO: 15585 - DNA, 239 bp, Homo sapiens
aagcataatatagcaaggactaacccctataccttatgcataatgacttaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggtgtccaagatagaattttagttcaactttaaa

SEQ ID NO: 15586 - DNA, 171 bp, Homo sapiens
ggaagaatcactgtacccaattttaagacttattataaagctacagccatcaacattgttggtattggcagagggatagacacatagatcaatggaacagaatagagaatgcagaaatagagcccacaacctctatgtataacttgattgtttgacaaaaaatgggaaagc

SEQ ID NO: 15587 - DNA, 134 bp, Homo sapiens
aggcagccagcgcaggggcttctgctgagggggcaggcggagtttgaggaaaccgcagataagtattttgactctaagaaagatagagattaaatacaacctacattaaaaaaatataggtccatagggaaact

SEQ ID NO: 15588 - DNA, 148 bp, Homo sapiens
aaccagtattctcagagataccatcagagaacaaacactaatgttaattgcccaattgagtgcttcatgcctttagatgtacaggctgacagagaagattcccgagagtaaatcatctttccaatccagaggaacaagcgtgtcttct

SEQ ID NO: 15589 - DNA, 246 bp, Homo sapiens
ttctaattggtcttccattctgcctttgttgctagcacttggaaagcaagttgttattctttctttttgctttagattattcactaaatgaaatattttgcaaatctatcaagcatatattgacaacttcttattcatttccacgggtcaattcagttgaactagctccatcattcatggggaggcctactgtgtgccacgcaccatacatagaacactgggtatacaaaggtgtgtacacataag

SEQ ID NO: 15590 - DNA, 158 bp, Homo sapiens
gacaatgaaaaaattgtcagtcgggacaaatgtacagcacacaaagggttattatttgtgaaaacttaggtgctcccccatgtgacttagaaggtttgaaggtttctcttaaaggaatcattcgtctttataaagtttaggagggtacacagggtttw

SEQ ID NO: 15591 - DNA, 423 bp, Homo sapiens
  misc_feature 64: n = A,T,C or G
ttaaaattattaacgagttattaaaacagttatttcatattcttattagtactaagtctttganatccaatgtgtattttacatttaccagagcatctcagttcaagctaaccacatttcaggtgcttggtagccagatgtaactagtgcctcctctatgggcgattacaaatctagagcaaatgtgaaagacgggtcgtaaatagtgggaagtcagattggagaaggtcgatgggccatagtatcccagatgctagtttagactcgattttctaggcatctggaaggtatggaataatgttaggggtgcctgtaatcccagctactttgggaggctgagggaagagaatcacttgcggaggttgcaatgagccagaccataccactgcactccagcctgggcgacagagtgagactccgtct

SEQ ID NO: 15592 - DNA, 359 bp, Homo sapiens
agggcttagcatacaaatactttttcaatagatggttgcctaattaagttgaggtataagggattagataattcctgacacttgttaaataaaggtgagaggagttcatgaagtcagctttaaggcagttacccctgattagggccactgggcactaagctttctgggtaagagttgcagccattcattgtggtgttaccatctctcctgaggagctactcgtgatagactacatattctccctctcccagtcagattgcctgttctcttgctttattaagacaatccatcgtggaaattataattgggatattctgtgacagtaaaatgagagcctataggcaatatattctatactm

SEQ ID NO: 15593 - DNA, 174 bp, Homo sapiens
  misc_feature 152: n = A,T,C or G
aagagtgcaaatgcacctcctgcaagaaaagctgcatctgcaaaggggcgtcggacaagtgcagctgctgcgcctgatgctgggacagccccgctcccagatgtaaaggaccgcgacttgcacaaaccttggattttttattgtacaccccntaaccggtgaccgttttctatw

SEQ ID NO: 15594 - DNA, 133 bp, Homo sapiens
gtaactgtatgaagtcatagataatagtacatgtcaccttaggtagtaggaagaattacaatttctttaaatcatttatcttgattttcatgttttattagcattttcaagaagacggattatctagaggatw

SEQ ID NO: 15595 - DNA, 281 bp, Homo sapiens
gattactaatatttgggaaggctttaaagacgcatgttatggtgctaatgtactttcacttttaaactctagatcagaattgttgacttgcattcaggacataaatgcacaaaatctgtacatgtcttccatcagaaaggttcaattgcatgcccaaggggttcttcctcctcatatccgtgtaaaggtaacctttaaaaccccatctttatggggcctgcttttgtacacactagacatagagagtgtgtgtgacatttatctctgtaaggcgtgtatgt

SEQ ID NO: 15596 - DNA, 160 bp, Homo sapiens
aagtcagagatatattaagtgaaataggaaaattgcagaagaatatgttatgactacagttttgaagaatatgtgtattttgtatatttgatgtgaatattttgctgtatatgtaggtatacaatagtaaattccgggtacataaacaaatcttggggac

SEQ ID NO: 15597 - DNA, 229 bp, Homo sapiens
  misc_feature 38: n = A,T,C or G
atgaaggcagaaataaagatgctctttgaaaccaacgngaacaaagacacaacataccagaatctctgggacacattcaaagcagtgtgtagagggaaatttatagcaccgaatgcccacaagagaaagcagggaaggttcgaaacttataacctaacactaaaatttaacggacctggaaaggcaggatcaacacacattcaaaggctggcagaggggcaaggatata

SEQ ID NO: 15598 - DNA, 169 bp, Homo sapiens
cccgagcttggaacttcgttatccgcgatgcgtttcctggcagctacattcctgctcctggcgctcagcaccgctgcccaggccgaaccggtgcagttcaaggactgcggttctttggatggagttataaaggaagtgaatttgagcccatgccccatccaatccttcc

SEQ ID NO: 15599 - DNA, 245 bp, Homo sapiens
ttactcccgacatggattacttaccgagagtacccagtcaaggccattatcatcaatcccatgctttccgatgagaccaatatatgcaatggtaagccagtagatggcctgcctactttgcgaatgggccattagttccattccgaggccattattcctggatcctaagcccattcagtccaccatctccaggtcggagaattactgaagtgggggggtatcccccccccattgatactgttttt

SEQ ID NO: 15600 - DNA, 251 bp, Homo sapiens
ccaaaggttaacattgctccactgttcaccaaggaagggggcagtggccatccgccgcggcctcacgtgcgttgtaacaagccctcatcacatatgtgagtcttacgtgcacaaaaagagaaggctttggtactgaaactggacaccttgtgtactcgataccttcacagcttctattggacatattttctttttggggagtgagggaaatttctcccatttgtgagccattcttttatcaattctacaca

SEQ ID NO: 15601 - DNA, 118 bp, Homo sapiens
tatcccacgtactccaacttccattcctcgccctgcccccggagccgagtcctgtatcagccctttatcctcacacgcttttctacaatggcattcaataaagtgcacgtgtttctgg

SEQ ID NO: 15602 - DNA, 214 bp, Homo sapiens
aaaataaatgtcatccaacttcctccctgtaacccaccccaaccatactttttcacaatgtctttgactagtcttctacatcatttattcttccctatggactttacaatgtccatattggctgagggagataattttgcagcttcataagtcaaggagcagaaccctgtggatttattctaaaaccttgaatctattttaagctgcatgaccc

SEQ ID NO: 15603 - DNA, 104 bp, Homo sapiens
tccatcaaccagcatctctattccccaccctcaatatcaacctgtaataatttatgctgtaaccaccaccgagagatagcttaggactggattacatcagtcac

SEQ ID NO: 15604 - DNA, 264 bp, Homo sapiens
caacattaatccattaaagctaacctatttttcaatatttatgataatctatgtacatatattgtctgtccatatgtatttgtaaataggttgtatataatgtcaggcttgggtcttgggttcaagtgtatatattcctgtaaggttcttaactgcattttgatgaattcacattatgtaactataaggcttgtcccaaaagtacctgtacagaaaattgaatattgaaaaattgacaaattgtgtacaaacactaaaaaggac

SEQ ID NO: 15605 - DNA, 200 bp, Homo sapiens
cccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaaggaaa

SEQ ID NO: 15606 - DNA, 245 bp, Homo sapiens
aaacaaaacaagcctcagtaaaattaagacagatagaaattatatcaaatatatttgcagtttgaaactagaaatcaatcaggaggaatttcagaaaattcataaatatccagaaattaaacaacgtgctcctgaacaaccagttggtcagtgaacaaattaaaagaaaaattaaaatatttgcaacaatcgaaaatggaaacacagcataccaaacctatgaaatacagcaaaagcagctctaa

SEQ ID NO: 15607 - DNA, 117 bp, Homo sapiens
ccaggcatggtggcttatgcctgtaatccccgcactttgggaggccaaagagggaggattgcttgagccagggagttcgagaccagcccgagcaacacaataggaccccatcgctac

SEQ ID NO: 15608 - DNA, 112 bp, Homo sapiens
agttcagaccggagcaatccaggtcggtttctatctatttacaatttctcccagtacgaaaggacaagagaaatggagcctccttaccataagtgctcccaaccaatttatg

SEQ ID NO: 15609 - DNA, 269 bp, Homo sapiens
aaatttcatgtgttttttcaatctttcttgtagtttagaatttggcttgctgcgtaatttaagctctgttgaatttgttccgtttgggattttggggggggggcatgtgtttagctggcatatgaagtctgagccttccggtgctgggcccaacaagaattgttgtaagttgtcaagcagctgcgcatgtctctgatgctttgtatcattcttgagcaatcgctcggtccgtggacaataaacagtattatcaaagagagaaacaaaaa

SEQ ID NO: 15610 - DNA, 452 bp, Homo sapiens
agaagagtaaagcttagtgcgtattatgcaggttcgcagagtgatatgtggcctacgactgtcattgtaatcaaaattgatttttgatcatttataaactaaaccatctaattgagagcaaaattactttaactgatgaaattcaagatgaagtgacagtagtcatgaatcgcagttctgtagatctgctaaaatgccaatgatctgttgattaatggtgatagtgtttaatatattagtggggatcacgtaaggagaatagaacacatattttgcccttaccttaagtcatgttgacatcatacataagtcaggtagagtctgaagatgtttcatccagcattcatcatgaagcaacagagtcaatagcgggcagttacagtctgtaggcaatgctgtctcgtgtggagtatgcaaacactaacagtcatttggcttcctctattccccty

SEQ ID NO: 15611 - DNA, 345 bp, Homo sapiens
aggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgtaaccccaaacaggcatgtatcaaaacacctgcggagtactttagactccaacaaataataatgtaactaaaactgctcacacattttactgtactttccaaagtcattactaaattgtgagtaaatcattcttgaacttagagtatgtaaatgtaatagttccgttatccaggaggagaaaaaaaaaaah

SEQ ID NO: 15612 - DNA, 316 bp, Homo sapiens
tgaagcacacataaatttgatcactcgccaagcttggctctatctacaaagctacttcatatttacagaaagttttctcaaatactgaggacaagttttgcctctagaggagttataggagctgataacttaatcttgggtaaatcctttgtgagaaatgaataattcaatcctttcctaatttgtctatatttctgtaaattatctccttattttcttttaaattgggatatggtcatctgttgagacaattttgtagaagtaggagaagaaaaagactttggatcagaagatcttgatttcacaaaaaaaaaaa

SEQ ID NO: 15613 - DNA, 142 bp, Homo sapiens
cagttcatcagtttaaaaattgtatgcaatctcttcatagttggtctcctaccccagtatctggccccaggccaaacaaccactgatcttatttatatcactatagattaaaattatatatcttgcctctttcacttagcat

SEQ ID NO: 15614 - DNA, 250 bp, Homo sapiens
gaagcagcaggctggtgctggggcttcttctctgaaggggctgcaagagggaaggcttagccatgtcgtccttggtcagaagggttatcagcaccgcgaaagccccaggggccattggaccctgacagtcaagctgttttaggcgacaggaccatttacatttcaggacagataggcatggacccttcaagtgggacatcttttttccacagaggggtatgcacaagatgctacacagagctctctaaam

SEQ ID NO: 15615 - DNA, 309 bp, Homo sapiens
tcaaaagacaggcaaacatctgtccactaaaagatatgtacaagactgctcacagtggcattatttatgacggtccaaaccaggagataatccaaatgtctgtaaccaagagaatggataaagacattttgatacgtcaatttaatggattactacttagcaataaaaataattagccacagttggcgcgcgtcgcttatgtcctgtaatgcccagcacattttggaggctgagagcagattgatcacctcgagagtttggagttcacagagcagactctaccaacatagagagcccccgtctctactm

SEQ ID NO: 15616 - DNA, 328 bp, Homo sapiens
ccttttgcggccatcaccgaagcgggatggcccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaagttgtacgttgacactataaaggtcagcaaattggcacagtagtgcaggtttacaggaagagatatattatctacacatgaacgggtgcagcgggaaaaggctaatgtgcacacatgtccacgt

SEQ ID NO: 15617 - DNA, 318 bp, Homo sapiens
gggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcacttttttcaaatgattctagtgaattgcctagaaatatctctctctgtacctcttat

SEQ ID NO: 15618 - DNA, 114 bp, Homo sapiens
attaggcagccagcgcaggggcctcttcttagggggcaggcggagcttaggaaaccgcagaaaaggtttttttttctttgaaagaatgagaattaaaacaacctcctaaaaaav

SEQ ID NO: 15619 - DNA, 188 bp, Homo sapiens
aaaataatgaggattgactgcttcatctggggaagtactgtacgtctgcgttttgtggcataggatgccttccctgtggcatcttcgactcctcttacctcaagttctggggcacaactggggaatgtcattattcgctcttcgagatgttatcaataaattacacatgggggctttccaagtaatgg

SEQ ID NO: 15620 - DNA, 203 bp, Homo sapiens
aaatctgaccaagaacacaagcatcttaatttgaatccacaaagtttcatgtaatgaaaagcaatacataattttcattcaacccgagtgttttccaagaagattgtatttgcttaaattgctacagtaattcaagggacagccctttctagacacagggttactgttgggtttttgagagactctaggttaaggatttgggg

SEQ ID NO: 15621 - DNA, 221 bp, Homo sapiens
tatttatttacttatttctgcctcacatattgtgcatatccttcttcattaacttaaaaagaactcaccccatggatcatctgaggtcgggagttcgagacccgccttacctacatggggaaggcctgtctcttctagcaatgcaaaattaggttggggtgtgccattcctgtctctttgtgcccacccgtttggggggtctgggcatatggggttttttt

SEQ ID NO: 15622 - DNA, 146 bp, Homo sapiens
gcagcggtgtaaatattgagctttatagctggctggtttgcaaaggcctggcaacgtcaacatttggagcctcatctgcaatgtaggggaccggtggacctcctccagcagcttggtgcttcatcagcagggggggtcctcccccc

SEQ ID NO: 15623 - DNA, 165 bp, Homo sapiens
aagattgcggcctcagcagcgcgaggtgctgcggcgctgcgtagaagtatcaatcagccgattgcttttgtgagaagagttccttaggactgccggcgtcgagtcagctgaaaggacactttgcacagttcggacaatgtcacgagggtcaatttaccctttgac

SEQ ID NO: 15624 - DNA, 123 bp, Homo sapiens
agagagaaagagacgtgtaaagatgtctataaagaaaagatgagaatcctttataaaagtaggggccaggttcgggtggctcacgcctgtaattccagtacttttggaaggtctaaggtgggs

SEQ ID NO: 15625 - DNA, 156 bp, Homo sapiens
ttcacagcatatattggtggattcttgtccatagtgcatctgctttaaggaattaaccgtaagcagtgtcaagacagtaaggattcataccatttgccgaaaagtgagtcttaagtgcaatttactctctttcttggcatttatttggtgggacca

SEQ ID NO: 15626 - DNA, 137 bp, Homo sapiens
tgatttctgcagtttcaggaagttgagggtgcttgctgcttggaggccttcctcgacatatcaaaggctggctgggcgttgtggctcacagctttaatgccagcttttttggaggccaaggtgggttgatttcctta

SEQ ID NO: 15627 - DNA, 171 bp, Homo sapiens
gcaaaggtagactagagtaagaaggcagtgtacagtagcacacagagctgtactctgcaagagcaaggtcatgacctgtctctcctcgaggtcttcagcgctcaagtagccagaggagtccatcacctggtcccgatcatacttcttgatagcagtgaatgcatcaaatgc

SEQ ID NO: 15628 - DNA, 246 bp, Homo sapiens
tctggcttggaggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaa

SEQ ID NO: 15629 - DNA, 169 bp, Homo sapiens
ctttcctcactatctgcttcatccgccaactaatatttcactttacatccaaacatcactttggcttcgaagccgccgcctgatactggcattttgtagatgtggtttgactatttctgtatgtctccatctattgatgagggtctcgacaaaaaaaaaaaaaaaaaaa

SEQ ID NO: 15630 - DNA, 517 bp, Homo sapiens
gctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaacccagcaaggtggttatcactaggctaaaactggacaaagaccgcaaaaagatcctcgaacggaaagccaaatctcgccaagtaggaaagggaaagggcaaatacaagggaagaaaccattgagaagatgcaggaataaagtaatcttatatacaagctttgattaaaacttgg

SEQ ID NO: 15631 - DNA, 301 bp, Homo sapiens
gcatgggactgatggaagaatttttcctttctaattagaagacctaaatgaagtaatttcaccaactaacaacttccttgagaattgtttgaatcaaggaaagctctgaaagaaaaagcagacaaccctgtgagaaagtttattgtaagacctaggtgggcaaaaaccagtgatacttccatgaaaatgagcatcgagttaaaatacctctggagaaattccttaaggcaaagttttgccaggaccagaagcatagtcaaaaaaaaaaaaaaaaaaaaaaaaaaaaaaaaaaaaaaaaaaa

SEQ ID NO: 15632 - DNA, 301 bp, Homo sapiens
  misc_feature 284: n = A,T,C or G
cactgatttctgacttaccaacattttgagttttttactattcctagtgtgaagataatttttccggacaatccaatggttcatagtaggttctttaagatatgtaaagtgtgttgtaaatgtaaagtattaacacacatgtggcaaaaagcagcttgttaagttggcatctcttcagctcctctcatgtgagctcatccccacatgtaagtgagataaccctttttcccaaggagttggcagtttacgacaattagattaaaaccaataaatgagaacaacgngactcattagtaaaaaa

SEQ ID NO: 15633 - DNA, 300 bp, Homo sapiens
  misc_feature 113, 130, 209: n = A,T,C or G
gaggaaaccgcagataagtttttttctctttgaaagatagagattaatacaactacttaaaaaatatagtcaataggttactaagatattgcttagcgttaagtttttaacgnaattttaatagcttaangattttaagagaaaatatgaagacttagaagagtagcatgaggaaggaaaagataaaaggttctaaacatgcggaggtngagatgaagcttcttcatggagtaaaaaatgtatttaaaagaaaattgagagaaaggactacagagccccgaattaataccaatagaaggg

SEQ ID NO: 15634 - DNA, 303 bp, Homo sapiens
  misc_feature 34, 272: n = A,T,C or G
ctagtgatgtataaaataaaatattctttgcagnaaaatattccctttgttaatgttatagaaggggggatacaaaaaggactaacaatttgtatggcagtgcagatatttttattttagtatttcctgttttggttatttgcatcttagaagagcataatgacattgtttgatgaagcctaattatgctggactgttttgacctggtttaacccttctgataggaagttgtggatgctggggatgagaactgaataatctttgcctggagngcactacactctagaatttccactttggaga

SEQ ID NO: 15635 - DNA, 300 bp, Homo sapiens
  misc_feature 165: n = A,T,C or G
cctgcccacagtgctcccttcacctctaacctggtgtgaagacctcttcaatggccaccatgtgggacactggtgggaagccccttagaaagtgcaggaagggaacacgtatagaatttgagttttttgtctgaaggggttgtttttttctttggtcattatggngacttaggatttgcaagatggaactaatgcgtgacttaacatatattatttggattgctaatatttcagttaccaagttccaagtacctttcaaatgaaagcttttgctagtaataagatttacagaggtaatat

SEQ ID NO: 15636 - DNA, 147 bp, Homo sapiens
  misc_feature 35: n = A,T,C or G
ataggcactgacaactggtaattctctctaagggntcaaaggtcattcacttggggagatgcctctaggaatcattatttcctagtaaccatcttcattcacattctggaaagattgttgtctaggaagagaaggcattttcattta

SEQ ID NO: 15637 - DNA, 138 bp, Homo sapiens
caatctggatgaggcagacaagttcattgaaaaatacaagttcattgaaaaattacatatagacatcccaattttcattctaaccctgtgccactaaggtctgaatagctctggatctattaggacatttaaaaaaaa

SEQ ID NO: 15638 - DNA, 175 bp, Homo sapiens
atctcgtaactctatcatacaaaaatttgtctaaatatgcctataaatgtctaacattgacatatcaagagaagagaattagcataatattatagagataacttccaaaagacagggtgaaaaacatcgtcttggtggtgggttagccgaccatttcaagatttgggggatttag

SEQ ID NO: 15639 - DNA, 167 bp, Homo sapiens
aatagatatagtaccgcaagggaaagatgaaaaattataaccaagcataatatagcaagggactaaccccttatagcctctgcataatggaattaactaggaaataacctttggccaaggagagccaggcttaaggacccccgaaaaccagaggagcctacctagga

SEQ ID NO: 15640 - DNA, 181 bp, Homo sapiens
gtgtagctttagaaccggtcagactggrgatacagcatcaccttcagatgtgttacgtgcgcttgcattcaactcggaactataaggaattctcaaggaagcctcattttataacctggcaaatcctgttaatgtcaatgccaaaaaataaattaaggcaggtacccggaacccatccgcc

SEQ ID NO: 15641 - DNA, 222 bp, Homo sapiens
caacctaccgagctgtacagctgttgtcagatagaatctagttcactttaatttgccacagaccctctaatcccttgtaatttaactgttagtccaagaggaacagctctttggacactaggaaaaaccttgtagagagagtaaaaaatttaacacccatagtaggcctaaaagcagccaccaattaagacagcgttcaagctcaacacccactacctgaca

SEQ ID NO: 15642 - DNA, 139 bp, Homo sapiens
  misc_feature 31, 101, 138: n = A,T,C or G
tgcatgtaaattattataaatwgtgaaagantttagcagtatggctagataaatttgcaagcccctgtatttccatatccttgacaattaaaggataaaanacacaactttcaaatattacttctaataawactttana

SEQ ID NO: 15643 - DNA, 179 bp, Homo sapiens
  misc_feature 101, 138, 150: n = A,T,C or G
tgcatgtaaattattataaatcgtgaaagactttagcagtatggctagataaatttgcaagcccctgtatttccatatccttgacaattaaaggataaaanacacaactttcaaatattacttctaataatactttanagaatacgtctnataacctgatactaacaattaattgacam

SEQ ID NO: 15644 - DNA, 124 bp, Homo sapiens
  misc_feature 50, 67: n = A,T,C or G
tacaaattaaatagattaagtcattttatttttattaagtacataacacntgacaaacgtggatganatgatgacaagttgcataacatggagcagtgatgattaagaggcagtgtataccagt

SEQ ID NO: 15645 - DNA, 256 bp, Homo sapiens
  misc_feature 13, 34, 140: n = A,T,C or G
aaagataaatganacaaagagctgataatttganaagataaaattgatagactgttagattaacacagtaatgaagacagaagatccaaataagctcaattagaaacataactggacatattacatctgataccacaganatagaaaagatgattcaagtctactctaaacaccttcatgagcacaaaatagaaaatctagagatgcatacattccttaaaacatagaaccctcctaggcttaattgaggaggata

SEQ ID NO: 15646 - DNA, 266 bp, Homo sapiens
tgtaataggaaaaatcactggaaatgaaaaccacactcttctatttataaaagaggggttgatttgataaagggatgagaaataagatgatttgcaaagttctgtttccgactactcatgaccacagggataggcaaaggtttattaccaaggactgtgctaaaaaagcccgtcgtgtgatatgttgtaaggttgcatcacgtaaccaaaatcagggtatgtcctgctggtgcccttaaggattctacctcaacattatacttttt

SEQ ID NO: 15647 - DNA, 241 bp, Homo sapiens
aacaagagctcatcctttcgtagtagatataaaagtaatttgtaaagggaagattgttttaggaacctgggcgatgctgcaaacacagagtagcctgatgcatttctgaggtaggtgaatcttcgtgtctttgagcatcaagccaataggaaggtactgggaacggtatttacatttgacaaaagaaattacctggttagctattagccaccagattggacaagattttttttagttttct

SEQ ID NO: 15648 - DNA, 281 bp, Homo sapiens
gtcacttgttaatttaatggacttgaacattgtagcagaattttctgagacacctttaatgtaatagaaccactgtaatagaatacataggacacatgtaatagaatatgttttgaccttcctctatgtattgttaacagcactacagcattcacatatctagtcaccttcaatttcaaagatatacctttgtccttaacagtttttatgtcagttttccactgtgagcagtgctcacatcaaggtttgttcacttcccactacttccttatttgagagtg

SEQ ID NO: 15649 - DNA, 557 bp, Homo sapiens
gctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgctgattacaacatgtaacttgtgactgtacaataaacataagcatatggtacaa

SEQ ID NO: 15650 - DNA, 508 bp, Homo sapiens
gacatggatgaaattgaaaagtacaaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaggaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaa

SEQ ID NO: 15651 - DNA, 321 bp, Homo sapiens
atttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaggattttgagttaacatctcttgaagccaaactccaccttctgtgcttctttgcttgggataatggagtttttctttagaaacagtgccaagaatgacaagatatcaaaaaaaaaaaaaaaaaaaaaaaaaaa

SEQ ID NO: 15652 - DNA, 517 bp, Homo sapiens
attcttttctgtttctgtttataatgaagaacactgtagctacattttcagaagttaacatcaagccatcaaacctgggtatagtgcagaaagcgtggcacacactgaccacacattaggctgtgtcaccattgtgtggtgtacctgctggaagaattctagcatgctacttggggacataatttcagtgggaaatatgccactgaccgattttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccaacggggccagcaaa

SEQ ID NO: 15653 - DNA, 296 bp, Homo sapiens
aaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggttt

SEQ ID NO: 15654 - DNA, 513 bp, Homo sapiens
agcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgtatttatcaatttttcccagtatttttatacggaaaaaatgtattgaaaacacttagtatgcagttgat

SEQ ID NO: 15655 - DNA, 365 bp, Homo sapiens
attatactgaagggagaaaagctgaaggcattccccccgagagctagaaaacaagaacaaacccaaacacagtagaagaaaagaaataaccaagatcagagcagaactaaatcaaattgaaacaaacaaaaaaaatacaaaagataaatgaaataaaaagctggtttttgaaaacgtaaataaaattgatagaccaatcgcaaaactaagcaaaataagaaaagagaagatccaaataagctcaattagaaatgaaacaggagatattacaactgataccacagaaatacaaaagatcattcaaggctattatgaacaactttatgcgcataaactagaaaacctagaggagatggataaattcc

SEQ ID NO: 15656 - DNA, 530 bp, Homo sapiens
ccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagcgatcttttgtgaagtgatcattaaagggatggagaacacagtctagtgtccagcaggcccacatgacagtttttgtaattcaaattatgcacttttaaaaaaaacaaacttaaacagggatcttaatatcttcctttgttttcctttgctttactcttctactttagaatattttcttaaaaatcactcaaaggactgtgaggaaaggctgtggtacctgaccttgttgaaatcaaggccgcactgactcaggcctgttacagattattacggtgactgatgggtccgaggcttcccaaagaggac

SEQ ID NO: 15657 - DNA, 198 bp, Homo sapiens
gaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaaaaaaaaaaaaaaaaaaaaaaaaaaaaaaaaaaaaaaaaaaaaaaaaaaa

SEQ ID NO: 15658 - DNA, 282 bp, Homo sapiens
tgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattaaaaaaaaaaaaaaaaaaaaa

SEQ ID NO: 15659 - DNA, 390 bp, Homo sapiens
aggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcactgagatgtttatgtgtatgcatatccgaaagcacagcacttaatcctttacattgtctatgatgccaagacctttgttcacgtgtttgtctgctgaccctctccccacaattgtcttgtgaccctgacacatccccctctttgagaaacacccacagatgatcaataaatactaagggaactcagaggctggcgggatcctccatatgctgaacgctggttccccgggtccccttatttctttctct

SEQ ID NO: 15660 - DNA, 193 bp, Homo sapiens
aaaatctgaaatggaacataaaaataacaacatacatttattggatacttcactgtgcatcagtttccaagctaagcacttgatacatgccatctcatttaatcctcacaagaatcctacaaggagctgttatgagaagaatctgggattgcaatggccccccaaatagagagggagccgagagaccaaagaa

SEQ ID NO: 15661 - DNA, 359 bp, Homo sapiens
aattaggtataatagcaaaaatgaaaattggcagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctga

SEQ ID NO: 15662 - DNA, 490 bp, Homo sapiens
gaggagaaacttgatgaaaacggtaggaaaaacctgataaaggtttgcgtaggttaccagctttctttctagggctgcgtgtggacctaatggaagagctgtctccatcagggcctgactaatagacatcttatcatgtcagatggactcaggagccaacttaaactggcttccactggccataaatgggatgatgtaaacatcaagaaagggaatcacagctgggcacagtggcttacacctgtaatcccaacaccttgggaggccaaggtgggcagatcacctgaggtcaggagttcaagactagcctggccaacatggtgaaacctcatctctactaaagatacaaaaattagccaggaatggtggcacctgcctgtaatcctagctacttggtaggctgaagcagtagaattgcttgaacctgggaggtggaggttgcagtgagacaagatcgcaccactgcacttcagcctgggcgagaagtgag

SEQ ID NO: 15663 - DNA, 420 bp, Homo sapiens
cccctatgctcaggctacaccctagaccaaacctacgccaaaatccatttcactatcatattcatcggcgtaaatctaactttcttcccacaacactttctaggcctatccggaacgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttgc

SEQ ID NO: 15664 - DNA, 423 bp, Homo sapiens
aggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgtttattttatcaaacattaagctttttaagaaaataattgggcagtgaaataaa

SEQ ID NO: 15665 - DNA, 339 bp, Homo sapiens
actcgaaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttc

SEQ ID NO: 15666 - DNA, 323 bp, Homo sapiens
gtttttcatataatgacttcttctcctttgggcagatacccagtagtgggattgctggatcgcgtggtagatctacttttagttctttaaggaatctccatactgttcccatagaggttatacattcccacctagcagtgtacgcaccgtcccttttcaccacatccacgccaacgtctattgctttttatgtgtttgatagaattcaccagtaatactatatgggtctgaagttttcttcacaaaagaaggttttttgttctgattttaatttctttaatatctataggacaatttccattttaaatttcttcagtcacttt

SEQ ID NO: 15667 - DNA, 530 bp, Homo sapiens
tcacagccaggcggcattccctgccacagtggcggcttgaatcatcaagaaatggataaatggggctttagtaaatcaggcttgcaggctcaaagctgcaatctgcccactctcaggtactgagactttgtaggcctcagacaccaggaagaaagttgggatacagtcatttgagttaaaaagggaatgacccctcagaaacccgcattagcagtgttactcttggaagtgcctttacttttaacgctctctgttctgaaaaagaggtgtttggttaccgtgtgagccaacatcacgttttgttagctgtgatttacctttgtccgtttaaaagacttcacggagccattctgtatacaaggtgtgttctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaa

SEQ ID NO: 15668 - DNA, 250 bp, Homo sapiens
tatagtagctagaagtattatttgataatgagacgaactcagacacctccaaaactgatgaaagtacattagccatctagattcaagaagctctctgactctaagcagaataaaaagaaaaccactgtagcaaaaaatctaactctaagctgaacaaaaataaaaccactcctagcaaaaacaaacaacaaaaacttcaaagaagcaacagtataactgattactgctcagcaaaaaatgatgcaaacca

SEQ ID NO: 15669 - DNA, 603 bp, Homo sapiens
cagccaggcgcagaggctcatgcctgtaatcccagactttggggaggccaaggcaggtggatcacttgaggtcaggagttcaagtccagcttgtccaacatggtgaaaccccgtctctgctaaaaatataaaaattagctgggcatggtggcatgtgctgtaatcccagctacttgggaggctgaggcacaagaattgcttgaacccgtggggcagaggttgcggtgagttgagatcgcaccactgtactccagcctgggcaacagaaagagactccatctcaaaaaaaataaataaataagatccattcccacaaaggatgactatttcaatcctagcaagagctcattaaatggtaacaaatcttcttcttctgtaaatggctcttcctaaaacaaataggtcaaggaccacaggcttaagaaataaatctgagttgcatctaatgggaaggaaatagttttatgccaatcatatgcataagtaaaccccaagttcccagaagggaattccggtttaaaaccaaaccaattcccccccctcatgaactttgccagttactagccgaagtcaagaagcccattcctatgtttctagccgagc

SEQ ID NO: 15670 - DNA, 253 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaagaaaaaaaaaaaaaaaaaaaaaaaa

SEQ ID NO: 15671 - DNA, 361 bp, Homo sapiens
cccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaag

SEQ ID NO: 15672 - DNA, 204 bp, Homo sapiens
ggtggatcgttaatcctgtctgggtaccccagctccaaggggatgagaggcagcaagtgagaggacacataggaaactgtaacaagacagaggcgagcagatggggagcttcagcggagtgttaagctaggcttcgcaatctgaccacttaactctcccagcaaagaaaagaaaggcttaaatactaaaaagaaggaaagctgg

SEQ ID NO: 15673 - DNA, 238 bp, Homo sapiens
aagacacttggtccatttggccatttaataagaagactgaagtctcatgttccataactttatcagcctaaaagtccctttgttgtatcataaacacataggctgaaacccctgtccttccaactcagagcaaattctgttgtattaaataaccatgccatgtactgaatatttttacacttatttattggacttgactcctacctccttcccgtaaaaaaaaaaaaaaaaaaaaaaa

SEQ ID NO: 15674 - DNA, 519 bp, Homo sapiens
ggttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgatctgtcaacaataaaaatagc

SEQ ID NO: 15675 - DNA, 361 bp, Homo sapiens
gacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgaccgtgctgcccctttcacatcaaagaactactg

SEQ ID NO: 15676 - DNA, 107 bp, Homo sapiens
agtggtggggaaaatgaacctcgtaacatttccaatgtccttcaagagggaaacaagttcagtgttatcatcgtggcattcattagttttttttttttaaaatcact

SEQ ID NO: 15677 - DNA, 361 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatg

SEQ ID NO: 15678 - DNA, 214 bp, Homo sapiens
tgaataaatgaaaaaacctttctttgcatttgcatatactgttgctagcattatacttggttctgaaaagtaatagttaaatgagaaatggtctcagtggcacatgcctgtgatcctagcactttgggaggcggagagaggccaagacgggtggatctcttgagtccaggagtttgagaccagcctgggtaatatagtgagactcccctctcta

SEQ ID NO: 15679 - DNA, 190 bp, Homo sapiens
aacaaaagcagtactcaaggggaggtctatagctttaagagcctacatcaaaaaaagaagaaaaacttcaaataaataataaataacttaatgatgtatcttaactagaaaagcaagaacaaaccaaacccataattagtagaagaaataaaaatcagagcaaaaaaaaaaaaaaaaaaaaaaaaaaaaa

SEQ ID NO: 15680 - DNA, 439 bp, Homo sapiens
agaactagagaaaaacagtcctaaaattcatatggaatgaaaaaagagcctgcatagccaaagcaagactaagccaaaagaacaaatcaggaggcatcacattacctgatttcaagttgtactatcaggccatagtcaccaaaacagcatggtactggtatgaaaataggcacacagaccaatggaacagaatagagaaccaagaaataaagccaaacacagccaactgatcttcaacaaagcaaacaaaaacataaagtggggaaaagacaccctattcaacaaatggtgctgggataattggcaagccacatgtaggcgaatgaaactggatcctcttttctcaccttatacaaaaatgcaatctacttatctgacaaagggctaatatccagaatctacaatgaactcaaaaaaaaaaaaaaaaaaaaaaaaaaaa

SEQ ID NO: 15681 - DNA, 360 bp, Homo sapiens
gggaacctagaagctcatcagatcccaagagagtttatagagtttgattttcagatccccctccccctttctttccccgaggtcagtaggtggggctgaaagttccaaccagctatcaatcacttggtctttgtagtgagcagccccatcctgaggctatctaggggctccacctcagtaacctcattagcataaactctatccagcataaattatatgcagatagagatagggtgatcaaaaagggctccttaaaagtaacaagacactcccattacctgggaagttcctaaggttttaggaaccctgtgtcaagaacctgagacaaacacgaaatttcttactataccgcatactagc

SEQ ID NO: 15682 - DNA, 560 bp, Homo sapiens
gcccaggttcatactataatttcagtggttactgccctaccccatttggaggaagaaaggataagagaaaaatatgtgtatctaagacttctcgagtttatataatgagtcagttatgcccatgtaatagctaggttgtatacatcaacacgggagtggaacatgtatgcaccagaataatgtttctcctttcagagtgagctttcttgcctgttaacaagtaatgtatttttattgattcgtgtaaatatcaagtgtttaaaattcatgtcacatacttctgaatatgacatattactaaatgctacagttacttttttgtcaaaatgtttttaataaaagtgttaaataacaaatttgtgtatttttgctgactagtgatgagatgtaatagcttaaagatgaaatggaaataatttaacaagtgcaatctatttcagaatggggacagaaaggaaaatacagctctgctttattaagtttcataaatttacaggattaaagatgtttcatttttccaataatgaaaaaaagatggttcctcctgatggtatttatca

SEQ ID NO: 15683 - DNA, 360 bp, Homo sapiens
gggaagctcatcagtgcctaacaatgccaagttttctttgttttattcctaatgggaacttatactgccatttgtctgtttcttggcataactctttgggaaggaagaggggttaaataaaaacaaaataatgcataccttttatgaatattatctctgggctgggtgaggtggttcatgcctgtaatcctagcactttgggaggacgaggtgggaggattgcttgagcctaggcattcaagaccagcctaggcaacaaagtgagaccccatctctatttttaaaaaaattaagaaataatattatttctgaattagtcttgctgttttttaaaacttggagtcaccctattggttaaga

SEQ ID NO: 15684 - DNA, 617 bp, Homo sapiens
ggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgaggtgaagcttcttcatggagtaaaaaatgtatttaaaagaaaattgagagaaaggactacagagccccgaattaataccaatagaagggcaatgcttttagattaaaatgaaggtgacttaaacagcttaaagtttaagtttaaaagttgtagggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtgggaggatgaaaccaatttggagaagaatagaagtttgaag

SEQ ID NO: 15685 - DNA, 470 bp, Homo sapiens
  misc_feature 225: n = A,T,C or G
tgctgcttgaagctgaaaacatcctgttacacctcggttttaagcaccctcccctggcctctgagataagcctctcaggaacctgtggctctctaacccagtttgaaacgttttgctctccatagaattgtgtaccaggagagttatattgattaaattaggtcttacattttatgttatatattcagagacatatatttgtagtctgcatttcaggtaaagcgntttccatgttggaggcaaatcccacgaggttcacgtatctattgctgctgctttaccctggtctggaaaagaaagttatttgcctgccgaacgcacagacatgagattagaaagtgatgacaagcggtaatgctggctctttttatcatagactatactctttctactctattatttcatctggggtggggaacatggatctcacaatgcagaaatctttttttcttttggtatgaaaaatttcc

SEQ ID NO: 15686 - DNA, 617 bp, Homo sapiens
  misc_feature 430, 550, 553, 560, 564, 577: n = A,T,C or G
aaataaaaaatttaaacatgtatacagcaacaagtacattaagtaacatttcaacattttaccatatttgcttcagatctcacttaagtaaaatattggttcagtcctactctcatccatttccccttcttcccaccccacaggtaatgattatattgaagttttatgcatgtgcatgtgtgtgcatgtttttctatgttttttatatatgtattcataaaacatttttcatttaaaagtataacaaaataatatgctgtatatatcatttgggaacggttttcatttaacattgtttttgaattgtattcatgcagtaaatgtacatctagtttgttatttttcactgctctatagaattatgttatatcaataagccactattcatttcccacataggaaggtatcccaattttcattttctaatttnctaatagggctggggtgaatatccttatatttgattcctgggcccatgggggagaaaatctccaaagaatacctagtttggttaattctgagcgatgatgcccccaaagcccatagaaanaancctaggnaggnttacctaaccccnggatgaacattcagaatctacattttaattatctgggtag

SEQ ID NO: 15687 - DNA, 205 bp, Homo sapiens
aggttaacacacttaagatgtttgcttaagtatatgagaatttgggtatataagaattgctggatcatttggtgtatatttaagtatatatgaaattacctttctcaaagtgatagtaccattttacattttcaccaccagagtatgagagttctatttgctgtatatcctctctgacatgttatgttgtcagggtttttttttt

SEQ ID NO: 15688 - DNA, 293 bp, Homo sapiens
tccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgt

SEQ ID NO: 15689 - DNA, 520 bp, Homo sapiens
cacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaaccgagtccagctgcctaattctgaatatatatatatatatat

SEQ ID NO: 15690 - DNA, 510 bp, Homo sapiens
agttgagttgagaggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaaacagcaaagcatttgtgtttggttggctatttgtaaagcaaccaccttccttattggaaggagaaaaaaaggggtacatacatgtaaatacttgctgcagcatttaatatgtttaa

SEQ ID NO: 15691 - DNA, 533 bp, Homo sapiens
gagcgtggggcgctcacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttggtgccaagtcttccatcttactagatgtgaaaccttggatgatgagacagatat

SEQ ID NO: 15692 - DNA, 359 bp, Homo sapiens
attgtaaagagatccaacagaatcactcctgctgaaaaatacgctttctgccacctacacatttctatttaggaagtaaaatttgcttcatggtcgtgaccccattagtcagtgttacagctgtgttggggataggaagtatatctggcagattgatatttatacacttttttataaagcagattttaaaatatagtaacatccatttttttcccttgaaagtgattctcttataaaaaatgaaagtggagtttaaggtatatcaaatcgttgtgggaggtgattaaaaatcaaaattcttttaaatatcaacttaattttttctaagtaagatacaaaaaattttcatctaaagtaat

SEQ ID NO: 15693 - DNA, 529 bp, Homo sapiens
gcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgctttctgtgtgtcagttttcatagtatccatattttattactgtttattacttccatgaattttaaaatctgagggaaatgttttgtaaacatttattttttttaaagaaaagatgaaaggcaggcctatttcatcacaagaaccacacatatacacgaatagacatcaaactcaatgctttatttgtaaatttagtggttttttatttctactgtcaaatgatgtgcaaaacctttactggttgcatggaaatcagccaagttttataatccttaaatcttaatggtcctcaaagcttggattaaatacatatggatggtactctcttgccccaaatatcttgaacattcaaattgtctg

SEQ ID NO: 15694 - DNA, 265 bp, Homo sapiens
gtttgtctagatttggtatcagggtaatactggtctcatagaatgagttaggaagtgttccttatcagctgatttttttccttttatatacccttgggtgcagagaactggaggttcctggaaattccattcctgatcccacagcagagaaacaggatagaacaacatgtcctgagagaccttttgatacatgccttcctctcaactttttgaagcagcagcactagcagcagagaacaaggaatagaagaaaaaaaaaaaaaaa

SEQ ID NO: 15695 - DNA, 260 bp, Homo sapiens
atcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaa

SEQ ID NO: 15696 - DNA, 194 bp, Homo sapiens
ttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaat

SEQ ID NO: 15697 - DNA, 249 bp, Homo sapiens
cagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataaaaaaaaaaaaaaaaaaaaaaaaaaaaaaaaaaaaaaaaaaaa

SEQ ID NO: 15698 - DNA, 342 bp, Homo sapiens
agcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacag

SEQ ID NO: 15699 - DNA, 481 bp, Homo sapiens
ggagcggtggcgcagctgtttcctccgatggagtcccttgtcgcctatgctggagtgcaatggtgcaatctcggctcactgcaactctgcctccgtggttcaagcgattctcctgcctcagcctcctgagtagctgggactacagacaccggccatcacgcccagctaatttttgtatttttagtagagatggggtttcaccatgttggccaggctggtcttgaactcctgactttagatgatctgcccgcctccacctcccaaagtgctgggattacaggtgtgagccacggcacctggcctgagaatcatttttcttaattacttgattccatgcttgtatcttccacttgacttgtatcttccagttggcttgcaaaatgcatggagaaacaaaagtcatatacctttttgaccttttctaagaaacttgtaaggaaatagagatagaatcaaagctttataatcacagtgtaatttg

SEQ ID NO: 15700 - DNA, 362 bp, Homo sapiens
gaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatc

SEQ ID NO: 15701 - DNA, 248 bp, Homo sapiens
aaatgcaccatgaagctttgagtgaactcttcctggggacaatgtgggcttcaatgtcaagaatgtgtctgtcaaggatgttcgtcgtgcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaa

SEQ ID NO: 15702 - DNA, 501 bp, Homo sapiens
tgaacatgtcaaggaagaattcgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccctctgcaggctttggaagatgatgtgtcttgcaaggggtaaagggcaaatggatttaatttctgcttaaaactatcatagacgttccaaatagaatatgtaaaatttctctgtattagaaaaagaacgtgatccaattggatattttcttttccttatttattccctgtagtctgcagatgataaattgtaaatacaatgattaaagagccgggct

SEQ ID NO: 15703 - DNA, 477 bp, Homo sapiens
aataagactgcaattaaaaaaaaatggatacattaggggcttcaaacacataatttctcaagaaatttccagatatctcatgctgcatagggcaggaggctgaaaagctaatttgagaagaaaacaagtaggatttttgttttgttttgcattttgctatatggaggagaaatgattagaccttaggaagtgccagtgggttggtcctttcatgaacatgccatcagtaaaagccctggaaacaaggtcataccagagattcattgtgccttgtcacaactgcaaacaatatctgagtggaatattcaaaaacttgcttagaaagaaaactctaggacagatggctccactgaagttattccaaatatttaataaataaagcataccaggcttttataaactcttctagaagaaaaaagttggaacttttccaattcagtttttcaggccagtgcaacccttgataccaaaaccaat

SEQ ID NO: 15704 - DNA, 359 bp, Homo sapiens
ggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaacgccattgacatggaaatcattgtgaatgcaaagactttggatggaggcctgaatgtcattcaattagaaactgcagtaggggctgccatcaaaagttttgagaattctctaggtattaatgtgccaaggagccgttt

SEQ ID NO: 15705 - DNA, 255 bp, Homo sapiens
ggtaaaggaatttatatataggatggtattctttacattgggatattggtattagagtccctccttaccaagaaatgaaatagtttttagcactcttagcattagagttcctagattgggtgttgatagctacagttttaaaatgtataacctgaaaatgaaggttaattttgcattgtaagagcacatttgatctatgtaaaaagtgtccatttggtgtatttttttaaaaaagagaaagcactttcatattaa

SEQ ID NO: 15706 - DNA, 233 bp, Homo sapiens
ggcagcatgttcgttaagagtcatcaccactccctaatctcaagtacccagggacacaaacactgcggaaggccgcagggacctctgcctaggaaaaccagagacctttgttcatgtgtttatctgctgaccttctctccactattatcctgtgaccctgccacatccccctctctgagaaacacccaagaatgatcaataaatacgaaaaaaaaaaaaaaaaaaaaaaaaaa

SEQ ID NO: 15707 - DNA, 510 bp, Homo sapiens
  misc_feature 389: n = A,T,C or G
gcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccccataaagagaaaacgagaggatgataaactggnggtggaatgcgtcatgaaaggcgtcacttccacgagagttatgagagagcataagccaagggacgttgcctggctgaagtcgcattgactctatacatctgtgggatatattgtcaaaaag

SEQ ID NO: 15708 - DNA, 343 bp, Homo sapiens
tcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaata

SEQ ID NO: 15709 - DNA, 410 bp, Homo sapiens
aagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatctatattaaaagtgggaaataattgtcaacattttttttgagtatagatttattaggggtggcaaagaagagtgctagttagcagttttccatgtaaagttgccttgactgatttgcccatgtcaagtgtaactcccccactccctgcaaaaggaattatttctaacccagatgtatcacttgaaacttgtagaagcaaaataatcagggaagtcctagaaaggtggtttgctttttggttttgag

SEQ ID NO: 15710 - DNA, 496 bp, Homo sapiens
atctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgtgataaaacttataaattcattgattaatct

SEQ ID NO: 15711 - DNA, 360 bp, Homo sapiens
gctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctg

SEQ ID NO: 15712 - DNA, 179 bp, Homo sapiens
aaaaagaggatgagagaaataacatatttattgattcacataagtatgtttttcttcattaatcgtctggagaaacccacttgtcattaatttgttttgggctaggttttcaaacttaccaaattgctttaaaaaagcaatttggaaggtaatttgataggctttccaacttaaccaaa

SEQ ID NO: 15713 - DNA, 527 bp, Homo sapiens
ggaggagcctgaggaagagggcggcgacggtggtggtgactgagcggagcccggtgacaggatgttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttgaaacaaacattattccatcatttgtgttgatggatatcca

SEQ ID NO: 15714 - DNA, 357 bp, Homo sapiens
attccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttcttacctgcacttagaggaaatttgaacaagttgggaaaaaacaatttttgtttcaattccaagaaacacttgcagctctagtaatcacttgagtcctcc

SEQ ID NO: 15715 - DNA, 314 bp, Homo sapiens
cagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttccagcaagtatccaaccaacttggttctgcttcaataaatctttggaaaaactccaaaaaaaaaaaaaaaaaaaaaaaaaaa

SEQ ID NO: 15716 - DNA, 315 bp, Homo sapiens
aatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagataaagcacacaggaacctaatggccaactgggatgaggtgactattctgagatgactattcagtggctaacttgggttaggaagaaaaataatta

SEQ ID NO: 15717 - DNA, 258 bp, Homo sapiens
cataaaaatgtgcgccaacaacggcaggcggcatctaaagcagcttctaaacagagagagatgctcatggaagatgtgggcagtgaggaaggacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctaaaaaaaaaaaaaaaaaaaaaaaaaaa

SEQ ID NO: 15718 - DNA, 359 bp, Homo sapiens
ggttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacgcccttctgaagagctagagttggataagtggaaaactaccatgaaatctagtgtgcaaga

SEQ ID NO: 15719 - DNA, 307 bp, Homo sapiens
agttgtagttaagtgactggaaggcaaaagagtgaaattgacaatgatggaaatcacatttaattagcatgaaatggtaagcagctgctatgttcaaatcttcctgttatgagattgtcagacttataaaatattatccacatggcgcagttttgaacagtgaaagagaagttgaatcaaaatttaaaagctcagtgcatagaaattttgggtcctaggagacacacaagaatttcccttttaaggaaattggctacgtattgtttgcaaacccctattctggcaaaaaaaaaaaaaaaaaaaaaaa

SEQ ID NO: 15720 - DNA, 540 bp, Homo sapiens
tcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaag

SEQ ID NO: 15721 - DNA, 525 bp, Homo sapiens
ctttttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgctaa

SEQ ID NO: 15722 - DNA, 327 bp, Homo sapiens
tctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgccacgagctcaatagggaagcctgtgatgactacagactttgcgaacgctcgccatggtttatggatacaatgctgccta

SEQ ID NO: 15723 - DNA, 311 bp, Homo sapiens
gttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccaaaaaaaaaaaaaaaaaaaaaaaa

SEQ ID NO: 15724 - DNA, 156 bp, Homo sapiens
catttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggca

SEQ ID NO: 15725 - DNA, 200 bp, Homo sapiens
attgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgaaaaaaaaaaaaaaaaaaaaaaaaa

SEQ ID NO: 15726 - DNA, 244 bp, Homo sapiens
tttcaccatgttttccaggctggtctcgaacccctgacctcaggtaatccttctgcctcgacctttaaaagtgctgggattacaggcatgaggcactgcgcctgcctctgctcacaatttaataatgcaaaaagacaatctataacacattgccattagaattccaaccactgctttttaggaatcaagactgatcactcttgacaagtggcagatctttccaaagcaccagataggggggaac

SEQ ID NO: 15727 - DNA, 359 bp, Homo sapiens
atgaacatggcggcctgctggcaaccatcctgagaaatgtatgggttccattatttttcagaagagccactcattcctatttataagggaatcaacatggctttgttggggggttctcattctctctgtctcattgagtttaatggagaaagagggaacacttgcttattttctataactgagcatcttcaattatcgtaaggaattatggattgcaagcacctgcattttctcaatctatgatttcctccatgcagcaatgcaaattagtagaacaggtgaggcaccaggaactacagcaccacttaatttattaactacagaaatcaataagaagcaacaagttggtaggacttcat

SEQ ID NO: 15728 - DNA, 342 bp, Homo sapiens
tacaacttaaggaaaacaagaatgttgtcttctaactctgacattataccttgtttgtacccgccagcgggaacttcattgcaggccgtgtgtcaccctgaccacgtctatctctgggggtccgcaccgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgctaaacttaacttaaatggttttttacaggagttaaagtacataaatgcctttttacagcttaatcattttggt

SEQ ID NO: 15729 - DNA, 231 bp, Homo sapiens
caaatatggttctatttgatacattaaaatatcttaatttgaagctaaaaatgctttgaataattaaatagatatataataaaaatgttgaattcatgtgtcatgcatactgattttgtacctcataagcaaagctacaatggtactaacagggtgtaatttgttcaaaataaatttttataccagatgatagtgaccttaaaaaggatttttattgctcaagccttccac

SEQ ID NO: 15730 - DNA, 283 bp, Homo sapiens
actgtaggaacaagcatgatcttgttactgtgatatttaaatatccacaggactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattc

SEQ ID NO: 15731 - DNA, 432 bp, Homo sapiens
attgcttttctaggatgaatgcttgcacttagtcctacagatagtcatagtactgttaactctaatacattgtgtattttttagcttttattgagtataacatacacgtagaaaagtacacaaataaatgaattttcataaagcaaacacatgtaatcatgtaaccatagcatggtgtaattttaatgaaatagttttatgatttatataaaccacgcaagaaaaatcagcacaaacagcctgggcaacatggtgaaacactgtctccactaaaaatacaaaaattagccaggagtgatggcatgcttctgtagtctcagctactggggaggctgaggcaggaggatcacttgagctcaggagaaagaggctgaagtgagctgaggtcatgccactgcatgacctgggtgacagagcaagaccctgtctccg

SEQ ID NO: 15732 - DNA, 429 bp, Homo sapiens
agtctcgccccagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgctaataattgaaccataaccatgtaatattatgtaaaggcctggaaattactgttgctaaaaaaagcatgtagtttcatgtagtgtagcatcctggcatcgtttccaaaatttggtcctctcccttttttttt

SEQ ID NO: 15733 - DNA, 361 bp, Homo sapiens
gaagctgaagaaagaaaacatggaaaagagaagacaagtagcacaaaagtacatagcagcaataagtgcaaatatattagtaattacagtgcatatgagttgaaaaaatcctccacttaacagaaactggttattagatgggataaaataacaaaatatatttatatgctgtttacaagcaataccttaaaaagcatattctcgcttgaaagtaaaaaggatttaaaaagatattcctgacactactaaccaatagaaatgttgtatggctatatatatcatgtaaagttgactttgaggcagaaaacctgtccgagagagtgagggtcactcaatagttataaaagggaggtataatttt

SEQ ID NO: 15734 - DNA, 363 bp, Homo sapiens
gaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcaggttcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagcca

SEQ ID NO: 15735 - DNA, 360 bp, Homo sapiens
tatggtgactcacgcttgtagtcccagcaatttgggaggctgagacaggaggattgcctgaggccaggagtttgacaccagcctgggcagcatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggaccaacttctctgatcaaaattacttttctgggtatgtgctgattaag

SEQ ID NO: 15736 - DNA, 516 bp, Homo sapiens
gaattcaggaaagaaagctgagctcatttgaattctgtgtcaggaaggactcttattgctagctgtcttgttattatacagggaacaatgttttcacatgattccattatatttctagtgctttattcgataagaagactacaaaaagggataaacttgactctatttccctgaacctgtttgtctccctactttagacttctcatttacttaatatttttttcttgtattctatacatatgagtaagattaaataaccttacatttctgcaacactgtagaattgttaaatcaaatctcgggggaagtttccccattagtgtaaattatttccataattcccattgtatctgtcagcaagaggttatataagactattcaaatatatattcggaaaatttgaggctaggcgtggtggcttatgcatgtaatcccagcactttgggaggccgaggccgcggacacgaggtcaggagtcgagaccagcctggccacacggtgaaaacctgtctctcc

SEQ ID NO: 15737 - DNA, 363 bp, Homo sapiens
gttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaagagagaagaggagaaggaaaaacaagctgaagaaatggcatcagatgatttgtcattaattcggaagaacagaatgactctctttcaacaattgacatgtgtgcttcctatcctggg

SEQ ID NO: 15738 - DNA, 361 bp, Homo sapiens
caagattgaatccgtaataaaaactctcccaacaaagaagtttaggacaaaatagctttactgccaaattctaccaaacttataaaggagaaataacattacttcttctcaaactattccaagaaactgaagaggaagcaattccccttaactcattctatgaggccagcattaccctgataccaaaaccagacaagaatgtaacaaaaaaaggaaatggcaggctagtgatgaacacagacataaaaatcaccaacataacactagcaaatcaaacccaacagcacatcaaaaaaggtaatgtagcatgattaagtgggatttatcccagagatgcaaggatggttcaacatacataaaa

SEQ ID NO: 15739 - DNA, 202 bp, Homo sapiens
tgagagagtagaaagggaagaatagatgttaggaaggcaacctgcagtttctggcacaactcccttgtgtgaaggagacagtcttcagctctgtgaactctcctggcagcccttgatgttggccagtattatagacgagaagccaggagagtcataatgaagcacttcctggggcaaaaaaaaaaaaaaaaaaaaaaaaaaa

SEQ ID NO: 15740 - DNA, 231 bp, Homo sapiens
tttctctttggttagtttttgatatttcttcccggagctcagaaatccccaaaaaaccagactttaccggataggaaatagaaggattcattctttgtctgtaaagccatattccaatgtacccccaggattctgggaaaaatcagccagttgccccagttagttgaagctgcagtagaggattagtgggtgttgcatggctgaattaaaacaacaacaacaacaagaatt

SEQ ID NO: 15741 - DNA, 202 bp, Homo sapiens
cctactcatgcacctaattggaagcgccaccctagcaatatcaaccattaaccttccctctacacttatcatctgcacaattctaattctactgactatcctagaaatcgctgtcgccttaatccaagcctacgttttcacacttctagtaagcctctacctgcacgacaacacagaaaaaaaaaaaaaaaaaaaaaaaaaa

SEQ ID NO: 15742 - DNA, 500 bp, Homo sapiens
taacgacgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcaggttttaaaaagttaagctgctatagtaagttactgggcattctcaatacttgaatatggaacatatgcacaggggaaggaaaataacattgcactttataaacactgtattgtaagtggaaaatgcaatgtcttaaataaaactatttaaaattggcaccctt

SEQ ID NO: 15743 - DNA, 139 bp, Homo sapiens
acaaaacctccagaccttacaggataggaaaatgcgcccagagcaaagggcagaagaactcggcggggatgaagaaaaaggtgaaacaccggccagacggcatgaggtctaggaagcgagcctgaccccggaggtcctg

SEQ ID NO: 15744 - DNA, 360 bp, Homo sapiens
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagccc

SEQ ID NO: 15745 - DNA, 563 bp, Homo sapiens
ataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacactgcactcatcatattttggtgtgcactagtgcaattccaagaaaatatcactgtaatgagtcagtgaagtctagaatcatacttaaca

SEQ ID NO: 15746 - DNA, 340 bp, Homo sapiens
cataacaagaggattcaagcagatttccctcttgcgtaaggctctccaggggaagcagtgacaatcatgacccagttcccattcttacacaatattttaatattattgtgtccagtgaggttcaaattaagtgtttaatggtagctgaggtaaatgtaaggagtaggaatagaaagaagattaaatgggggagaaatagtggggaaaaacagttcttagaggagatgaaatttgaattgggccttaaaagaaggggctcaggatttaaatttgtggaaagttgaggtagaaagggcattaccggagaagaaaacctgcatgaagtcttcatctggaaaaa

SEQ ID NO: 15747 - DNA, 514 bp, Homo sapiens
catattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcactgtgcatatggaaacagggacatctccatcattactggcttagttttgcttcctttgacacagt

SEQ ID NO: 15748 - DNA, 510 bp, Homo sapiens
gaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacatt

SEQ ID NO: 15749 - DNA, 115 bp, Homo sapiens
gaagactatggcaccagatgaagaataaacaaggaaaacaacttcaggttattaatattttcaaataatatgcatgctcccaataactgtaaaaaaaaaaaaaaaaaaaaaaaaa

SEQ ID NO: 15750 - DNA, 457 bp, Homo sapiens
ataatctctaaatgcagcactcccagaaattgaggttgtaaagagaccattaattttgcaaatgattaaagtctctcactggttgctggaacctctgttggaatgctgtctttagaagctgcatttggattccatatattctttttttgagattatatccccttatttcctaactctataaaataaatgtgtgattccaaaacctggtgtttgccaggtatcttctaagtctataatacgtattttataatattgttggtactttgctatttcaggaggacacctatatcctacatatttatatttgccaatgttgctttactgtttgcacattaagttgtggcatatttttgtgtttttgagctgggagtccatccaacacaccatgttcactttgggtataccaaagtatttacgctcctatatctagggaacattatacatgcaatagattgta

SEQ ID NO: 15751 - DNA, 546 bp, Homo sapiens
gcgagaggatcatggcggatggccccaggtgtaagcgcagaaagcaggcgaacccgcggcgcaataacggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacatggcatgaaaccataaatccgtaacaggaggaaaattggaaaattcacaaatatgtggaaattaagcaacacactcctgaacaaccaaaggtcaaagaagaaatgaaaggggaagtaaaaaatatcttgaaac

SEQ ID NO: 15752 - DNA, 600 bp, Homo sapiens
  misc_feature 514: n = A,T,C or G
gctaacctataaacataaaccttaggaatgaggctactgagactgaaataaagcttatacttttgtgacaataattttgtgcctcagaattctaatacaaaccattaatcatagatttcatggcccaaattagtcatcttctaactgctatgcagctttgcctggcaaataaatagtggtttgctaaatttctcattcttagaagctttggaaaggctagaatttaaacattactctcctttttcaattagtttttttctcccacacgtctgcaccatgccactttctgtgacatttccttagaaaatcaaatatttttgaaaaattctagtgctattaccggtaacttttctttagacataaaaagccttatgctcaaggttcagatctgaaaatttgcttagttatcacatttttgtaagccccattttaaaaaatttatgataaatattaagctagggtggcccggaaaaaattaacttcacacatattcaggtctggctggggataaaanattgcactggtcttggttaaggagatgataaaacagatttccaaatggggggaaaatttaagaaagtctaaagggaagaaagggca

SEQ ID NO: 15753 - DNA, 359 bp, Homo sapiens
attccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccgggttttaaatagtttgtaaattttcagtttctacacactttatcatccactc

SEQ ID NO: 15754 - DNA, 447 bp, Homo sapiens
cactctcttcaacggggacactcagtatgtctgctgatgtaccccttgttgtagagtataaaatcgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagtttaagaattgttttgaatttaaataaagtacttgaatttc

SEQ ID NO: 15755 - DNA, 334 bp, Homo sapiens
gaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaa

SEQ ID NO: 15756 - DNA, 570 bp, Homo sapiens
  misc_feature 12: n = A,T,C or G
cggaccgagagnaccttgcgacgcagtctatgtccggcgccacatagtcgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgcatgaactttgttgctgaatcattctcatttacttaattgaggagtaggagactaaaagaatgtcactctttgaattcctggataagagtctggagatggcagcttattggacacatggatttctcagatttgccttactgctagctctgcttttaatgcaggaaaaaagcccaagagttcactgggtggcaaaacaactttctaaaaaacatttt

SEQ ID NO: 15757 - DNA, 145 bp, Homo sapiens
tctggtacaactgtccttagactgatgagcaaaggaggagtcaactaatgaagaaatgaataataaattttgacactgaaaaacattttattaataaagaatattgacatgagtagaaaaaaaaaaaaaaaaaaaaaaaaaaaaa

SEQ ID NO: 15758 - DNA, 560 bp, Homo sapiens
atatttaggaaataatatacttaaataaatgaaaggactaaaagagttttcaataaggaactttatctccttcccacagtcagagatgcatctaatccaaccctgactcaatgggtttccaattatcagaaatggaaatgattcagtgtttatatgctctgttgctgaacaagcctcactgtcacaaagtgattccttatatttcacctgtaattgtagctatatgttacagcatgaatgagaattggaaaagagggtagttattttgattgatgtagacagccaaagtgggtaattgagacccctgaaacttcctttaggatttgaatgatcctatttggctgtcttggggagcacaacagtgggataattaccatatttttactccagtgtgtggacaactacttctaatactgttttctcagtccatttgcatttagattctattggggagtaaaatggtgaagggtgaaattaaccataaaatatattaatctgtttgaactcaagtagatttaaaaatactagatttaaccatctgaggaaacagacttgcctcc

SEQ ID NO: 15759 - DNA, 228 bp, Homo sapiens
gctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaaaaa

SEQ ID NO: 15760 - DNA, 407 bp, Homo sapiens
cttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacgttttgtcatataagattcatatttacttcttatacatttgataaagtaaggcatggttgtggttaatctggtttatttttgttccacaagttaaataaatcataaaactca

SEQ ID NO: 15761 - DNA, 363 bp, Homo sapiens
atacaaactctcaccacgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattattatgcttttgcacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaa

SEQ ID NO: 15762 - DNA, 526 bp, Homo sapiens
aactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgcctcgatggcatattatgatgtaatgctaatcgcttgtagggatagtaaatggtcagtattgaaacctaatctctagctgccgccttgtagatatgaacgaatgtcaccaagcctgtatttggattttggtggcatggacactgcactaataagccaaggaatcgacatatattaggtgcgtggcctg

SEQ ID NO: 15763 - DNA, 363 bp, Homo sapiens
atattcaatggagaaagactgaaaaccttccccctaagatcaggaataaaataaagacttccactcctgccatttctattctagctggggcaattatataagataatgaaataaaactcatgtagattgaaaaggaagttgtaaaactatttctgtttgcggatgacatgattttgtgtgtagaaaattctaaggaacacacacacactcatacacaactattagggctaataaacgagttcagcagagcttcagggtaaaagataaatgtacaaaaattgtttctatacaccaacaatgtacaatcaaagaatgaaattaaggaaacaagtttatgtacaaaagcatcaaaaagaataggat

SEQ ID NO: 15764 - DNA, 362 bp, Homo sapiens
cttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaagataat

SEQ ID NO: 15765 - DNA, 507 bp, Homo sapiens
gggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatg

SEQ ID NO: 15766 - DNA, 333 bp, Homo sapiens
agctccgctttcgctacagcatggtggcctactggagacaggctggactcagctacatccgatactcccagatctgtgcaaaagcagtgagagatgcactgaagacagaattcaaagcaaatgctgagaagacttctggcggcaaccgtaaaaattgtgaaagtaaagaaggaataatctaccctgactaaagcttgaaatgctacatttccaaggtgaagatgcgtgggcacatgttatggcagattgaaaaggatctcattccatgggaaaaaaaaatcctgtcttgttcataaattgacaatgtcaataaattgaaatatggtcactgtt

SEQ ID NO: 15767 - DNA, 359 bp, Homo sapiens
attttaaaatgttttttgggcatttatagaaacagattctgatcttaaaagctcaccagggaaaatatgtacaactattatgtatccataaaaattttaaaaaaacacaaaaaagctcaccagggatactgcctggtttgctatattcctattaggaatttgttcatattttaactgatagctgtgtcttcagggcacaataacttaatatttgaatataagttgttaagcacaaatcagttactctgcctgatgaaatgtttgattagtaaaactccatgaatactgattttattctaaggcctgagccattagtttaacaaagcactgaaatgattctgctgttgccattaccaaaa

SEQ ID NO: 15768 - DNA, 359 bp, Homo sapiens
acttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagc

SEQ ID NO: 15769 - DNA, 362 bp, Homo sapiens
aactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaaga

SEQ ID NO: 15770 - DNA, 154 bp, Homo sapiens
acttctgtagaacactggccataggaaatgctgtttttttgtattggactttaccttgatatatgtatatggatgtatgcataaaatcataggacatatgtacttgtggaacaagttggattttttatacaatattaaaattcaccacttcaga

SEQ ID NO: 15771 - DNA, 320 bp, Homo sapiens
aattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagttaaaaaaaaag

SEQ ID NO: 15772 - DNA, 543 bp, Homo sapiens
cagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccacaggtggaaataagaaccacttcatgcagatatggatactaatgggtatgaaacagataccttaccactgacccaaactcgtccatatgactgc

SEQ ID NO: 15773 - DNA, 318 bp, Homo sapiens
gattgaaggccgggctcggtggctcacgcctgtagtcccagcactttgggaggccaaggcgggtgggtcacttgaggtcaggagatcaagaccagcttggccaacatggtgaaaccccatctctactaaaaatacaaaaaaattagctgggcgtggtggcatgtgcctgttgccccagctactcaggaggctgaggcaggtgaaccactttaacccaggcggcagaagttgcagtgagctgagatcaagccattgtgctctggcacgggtgacagagcaaaactccgtctttataaaaaaaaaaaaaaaaaaaaaaaa

SEQ ID NO: 15774 - DNA, 354 bp, Homo sapiens
gcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatg

SEQ ID NO: 15775 - DNA, 332 bp, Homo sapiens
ggtggctactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttt

SEQ ID NO: 15776 - DNA, 587 bp, Homo sapiens
gcaaacaaaattgttcttgggagaaaatcaacttttagattaaaaaaattttaagtaactaggagtatttaaatccttttcccataaataaaagtacagttttcttggtggcagaatgaaaatcagcaacttctagcatatagactatataatcagattgacagcatatagaatatattatcagacaagatgaggaggtcaaaagttactattgctcataatgacttacaggctaaaattagttttaaaatactatactaaattctgaatgcaattttttttgtcccttgagaccaaaatttaagttaactgttgctgcagtctaagtgtaaatgttaacagcaggagaagttaagaattgagcagtctgttgcatgatttcccaaatgaaatactgccttgctagagtttgaaaaactaattgagcctgtgcctgctagaaaacaagcgttatttgaatgtgaatagggttcaaaggtatgtaggtacagaattcctccaaacagcttaaattctcaagaaagaatcctgcgcagttattccctacctgaagctcaatcatttggatcaacaccgctctctcggga

SEQ ID NO: 15777 - DNA, 343 bp, Homo sapiens
gctcttcttccggctggaaccatggagggtgtagaagagaagaagaaggaggttcctgctgtgccagaaacccttaagaaaaagcggaggaatttcgcagagctgaagatcaagcgcctgagaaagaagtttgcccaaaagatgcttcgaaagacaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaagg

SEQ ID NO: 15778 - DNA, 361 bp, Homo sapiens
agtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgc

SEQ ID NO: 15779 - DNA, 530 bp, Homo sapiens
taaacttcaattttttatatttaaacttcaattttttagcaacagctgaatagctttgcggaggagtttaatagtgtacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgcttcatattgtttttatgattctaatcaagctgtatgtagagactgaatgtgaagcaagctgagccaaaaagataatgccaatgagattgcctaccattttataggatatttactatgtatttatacgttaagacctctatgagatgtatcagagaatgtctttgtaactaactggttaattcaatctgtaataaaaatctaactaactaactcatttattctattaaaaaggattgtcctttaggcggggaatgggaatccttgctgccc

SEQ ID NO: 15780 - DNA, 229 bp, Homo sapiens
ctggttaagccagttgttcatacttcctttacaaatataaagatagctgtttaggatattatgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgag

SEQ ID NO: 15781 - DNA, 361 bp, Homo sapiens
cacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcagttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatca

SEQ ID NO: 15782 - DNA, 547 bp, Homo sapiens
ggctgactccaacttccaatacaacagccatcactagcacagtgtttttttgtataaccaacgtagtgtgtattagtagttctatcaagagaactgcttttaacattagggactgggagcagtccatgggataaaaaggaaagcgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggtctgcttatgatactctgcacgctgccttttagtgagtgaggagtttggggttgcctagcaacttgctaacttgtaaaaagtcatctttccctccagaaagaacgaaagaaagcaaagcaaagtcagtgaaagacaatctttatagttcaggagtaaatctaaatgtggcttttgtcaagcacttagatggatataaatgcagcaacttggtttaaaaaaa

SEQ ID NO: 15783 - DNA, 202 bp, Homo sapiens
attttaaagaaagttagttcatagttgttgccttttaactcatagtcaagcttcagtctttcaaagagaaatgtgtgatttcatttacttgctgatattttgtagtttggagatccttgtgggcattattctaactgatacgtagacacttacttggaaatttttggacattatattaaatgagtgctatctgtgaaattgg

SEQ ID NO: 15784 - DNA, 505 bp, Homo sapiens
gaccaaaggctaagagagagacagtcactgtggtggggggaaccctctgttcctagaaaatcacaaagacatcttcccttgagctatatccccagttactagacattctctgatattgccaaacaatattacttacctgaactgtaaaacttcccacatatatttcatacacaggataagagatatgatagttgcaaacaggaaaggaggaaattatgataggaaagttggggatcctgttgctgacaccccatcagggcagtcagaggctggggtcagtccagaagcctttgaataataccaggtgggagctctggccagaagaaatattcatttgccctaggacttctttcagtcccgtgcaacaactaagtcctccatgaaaggtctaaaatggaggctgagagcctcagaaggaaaggacagagttggagttcgctcccctctactcaccattttgatgaatgttgtacttggtatcctagacaagggtcccattatgaag

SEQ ID NO: 15785 - DNA, 363 bp, Homo sapiens
gggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctccc

SEQ ID NO: 15786 - DNA, 398 bp, Homo sapiens
agaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgttttttctagtgat

SEQ ID NO: 15787 - DNA, 364 bp, Homo sapiens
gtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaaaaaaaaaaaaaaaaaaaaaaa

SEQ ID NO: 15788 - DNA, 217 bp, Homo sapiens
gggaaacactgtctctacaaaaaatacaaaaattagcctggcgtggtggcgtacacacatggttcgatctactcaggaggctgaggtgggaggatcacttgagcctgggaggccaaggctgcagagagccgttattgcactgcactccaacctgggcaacagaatgagaccctgtctccaaaaaaaaaaaaaaaaaaaaaaaaaaaaaaaaaaaaaa

SEQ ID NO: 15789 - DNA, 536 bp, Homo sapiens
aaacaaaatgtagtatatccacaaagtggaatattatttggcataaaaaggtatgaaatattgatatatgctttaacatggatgaacttcaaaaacaggctaagtgaaagaagccaatcatgaaggaccgcgtgctgtatgactctgtttataggaaatggtctggaataggcaaatctgtagagaccgaaagtaaattatggtttcctaggcctaggaaccagtgaggggtgaggaggatagctaaggggtagaaggtttctttggggataatgaaaataccctaaaattgattgtggtgaaggttgcacaattctgtggatatactaagcacaattctgtggatatactaaaggcaattgaattgtacactttatgtgggtgaattgtatgccgtatgaattatatctcaacattgtattagaaaataaaattaatgaagcatagaagttacggagaactactggaaagaagaaatacaagactcaggaagagacagcagacaacagtagagtgtgaaatgggaaccagcagaa

SEQ ID NO: 15790 - DNA, 508 bp, Homo sapiens
atatatatggcttagtcaaagtgaagggaattattattatagggtatggaggaggccttaaggaaaccaaaacttatcttaagaatgggaaatgggacaagggctttttttataaaggataaaaatttactaaatccttatattagaagaaacagaaaatggggaatagctctggtatttggttaactaaattgaatttataattcagaggcttcccacaaagaacactccagatccagatgctttcactaatgaattccttcaaacatttaaggagaaataccagtcttaaacaaagacgggaaataagaggtggggagaacacttctagtcattgtttgagagctttgtaattctaataccaaggtcctgataaggacattattaaaaaagtcacacatcgatatgccttatgatcatagacacaaaaatgtttaacatacaattaggaaataacacataatcactgcagtgatgtgttattatgtattaacatacagtaatatat

SEQ ID NO: 15791 - DNA, 330 bp, Homo sapiens
taatgtgcttccactgttgttcgagcagtagtgtttgtattgaaatcgtgcctgttcacatcccacactgcttgtgttgggtggaaaccacttgtggagatgctgcttgatatacagatcctgctccatctgtgcatttgaaattcataggcatctggagacagtggcatagaagcagtgggcgcaggaaaagtacaactcagagtttacaacgagaaaaagtgaaaaccacctggcacatagctaatgttttagaatgaaaagtgacttccattccaattgaagtcagcccctgctgtgtaattaagcagatatttaaaaaaaaaaaaa

SEQ ID NO: 15792 - DNA, 260 bp, Homo sapiens
aaaagcattctaatcagatggagaaaagcattgaacacgttttgttcataagtttttgcctcagagaagatcttgagaaattttggagaaaatgattatataggtatctcccatctgtctctttcggcttctgcaaaaatttctaaaacaagcaggcatcctctttataattagaacacaaaccattattttaaaacgcttattttagcaagaggcaaactttccaaactaagaaacagccaaacattctaacaaaaaaa

SEQ ID NO: 15793 - DNA, 495 bp, Homo sapiens
tttcttacttatctgacatcatagaagattgctaatttgaattgtctcatgaattttcaattttttttttctgaaacagacaatataaactgaaataagatctattacaaaggtaactttttcctagtctgttcatgggattcttaagtgcacataaccacagaatcaaataataatctaataatattaagccacttaaaaatatagacttgaggccaggcgccatggctcatgcctgtaatcccagcactttgggagaccaacgcaggcagatcacttgaggtcaggagttcaagactagctggccaacatggtgaaaccctgctctactaaaaatacaaaaattggccggacgtggtggtgtgcccacgtagtaagtgcccagctactcaggaggctgaggcaggagaatcacttgaagtggcaggcggagatcacgatgagccgagattgcaccaccgcactccagcctgggcaacagagcaagactcctct

SEQ ID NO: 15794 - DNA, 508 bp, Homo sapiens
attttgaacggaggagaaacttgatgaaaacggtaggaaaaacctgataaaggtttgcgtaggttaccagctttctttctagggctgcgtgtggacctaatggaagagctgtctccatcagggcctgactaatagacatcttatcatgtcagatggactcaggagccaacttaaactggcttccactggccataaatgggatgatgtaaacatcaagaaagggaatcacagctgggcacagtggcttacacctgtaatcccaacaccttgggaggccaaggtgggcagatcacctgaggtcaggagttcaagactagcctggccaacatggtgaaacctcatctctactaaagatcaaaaattagccaggaatggtgcacctgcctgtaatcctagctacttggtaaggctgaagcagtagaattgcttgaacctgggaggtggaggttgcagtgagacaaagatcgcaccactgcacttcagcctgggcgagagtgagactcagtct

SEQ ID NO: 15795 - DNA, 314 bp, Homo sapiens
atataaatccagaaatagtctcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgaccatggtgatgtacggggtgaattctcttgccgtgttgcaaatgtgtagaataaagattatctggcaaaaaaaaaaaaaaaaaaaaaaaaaaaaaaaaaaaaaaaaaaaaaaaaaaaaaaaaaaaaaaaaaaaaaaaa

SEQ ID NO: 15796 - DNA, 272 bp, Homo sapiens
gagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaggaacattctgtttctgaaaatcaagagtt

SEQ ID NO: 15797 - DNA, 303 bp, Homo sapiens
catgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagctgaaaaaaaaaaaaaaaaaaaaaaaaaaa

SEQ ID NO: 15798 - DNA, 256 bp, Homo sapiens
ggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaaaaaaaaaaaaaaaaaaaaaaaaaaaa

SEQ ID NO: 15799 - DNA, 280 bp, Homo sapiens
cagcgcaggggcttctgctgatggggcatgcagagctctgaggaaaccgcagataagatgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcgtggagtaaaaaat

SEQ ID NO: 15800 - DNA, 364 bp, Homo sapiens
gaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttaaaaaaaaaaaa

SEQ ID NO: 15801 - DNA, 368 bp, Homo sapiens
gcagaaaattattgaaataaaagatgggatttggaccactgtggcttgagcaaaagaagtgtgaaacaacaggtgccatgggatgttatctacgtttttaaattaacatctgtttttagctgaaagcaatttgcagagaatgcaccacgtgcctttattcagagctaaacactgactactgagacgccgctaagtagtaagggtttagtaaaatataaagattttccttgggaggaaagaataatggagattattcactggatatagatgtctaagagaaatctctgttaaacctatgtttggcataaggtatggtagcagtttaagaattttttcatttgggaaaattgaaagaatctagagaattg

SEQ ID NO: 15802 - DNA, 575 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaaggcaatgcttttagattaaaatgaaggtgacttaaacagcttaaagtttaagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagt

SEQ ID NO: 15803 - DNA, 359 bp, Homo sapiens
aatctcagaaattcaaatttaagcatggggcccaagagtatgcattcttaccagataccttgggcagtgactgtcaaaagtttggtcccaacaaacagcattaacgtcacctgggaacttgttggaaatgcagcctctctcggggcctcatctcagatcagatgtactaaatcagatactctaggggcaggggcaggggcaggggctagcagttgtgtttaagcaaactctgcaggtgtctttcttatcctagtttgagaaccaatacccaacaacctacgtgattttggtgcaagtagtgtttgaaacacactgaagattactgccctattactaagacatttttcaaaaagcatgtt

SEQ ID NO: 15804 - DNA, 150 bp, Homo sapiens
cttcaatttttgagtccagaaaaggacagcatacaagtttctgctatcattagtgctcaatctgaatgaattacccacactggagggatattaatgctttaagtcaccatcctttcggcttaaaaaaaaaaaaaaaaaaaaaaaaaaaaa

SEQ ID NO: 15805 - DNA, 359 bp, Homo sapiens
gactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagc

SEQ ID NO: 15806 - DNA, 609 bp, Homo sapiens
agacaaaatggcatgcgcacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgctgatgtaaatttcagccatatatggattgatatggtttggatgtatccccacccaagtctcatcttgaattttaatcctcataattcccaggtgttgtggtaggtaattgaatcatgggggcaggttccctcatgctattctcatgatagtgagctttcatgagatctgatgggtttataagtgcct

SEQ ID NO: 15807 - DNA, 345 bp, Homo sapiens
gagaacctggatgccgcactcagggcgctcctcatggaagatgccacatctgaggtctgtcagcaacagcagcttttccaggatccaaaatcatcagcaaaattaaaagagcacccctctcaatttctaaaaagagattttttatactattaaaaaatagactattttttaaactactcattcctgacttatgtatttacgttagttaattttgatgtcatgggtgtatgctgtcttctttcaccaagtggtagatataattgtgtgtgtgtgcgtgtgtgtgtgtgtggatgataaggttggtgattcaaaggtggctttatttatttaaaaaaaaaaaaaaaa

SEQ ID NO: 15808 - DNA, 360 bp, Homo sapiens
gttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaag

SEQ ID NO: 15809 - DNA, 440 bp, Homo sapiens
gatcccaaggtgatggcagactttttctgtaaaggactagagaataaatattttagtctttgtaggccaatctctgtctcaacaatcaactctgccattgttctgcaaaagcagcaataaacaataaattaatgagataaatgtattccagtgaacctgtatttacaaaatatgtgcaaggctagatttgccacacgggctatagtttgccgtcctctgctgtagcatgccaaaagctctgtttagagtcacagccacttctgacatttagatcagcactaaatgctggactagtgtctccttaatctatcttgttagctcttcagtgccttctagcatatgttgagtttttatgtttcttagcaggagattaacctaaaaagtttagtttgccactaccagaagaaagtcatatataaagtaaccaatgctttgaaaaa

SEQ ID NO: 15810 - DNA, 292 bp, Homo sapiens
atgattcaaaatctaagcagtttcgattttgcctgtgaatatggtgactgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttggatagctt

SEQ ID NO: 15811 - DNA, 348 bp, Homo sapiens
atactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattgggaatggatgggggacagtgaggaggacacaccagccca

SEQ ID NO: 15812 - DNA, 221 bp, Homo sapiens
ctcccctaaaggaatatgacataattagatactgttatttaggtaataacacttttcccacttaaatggcatattcttaaaaaaatctataaatatacattttgctcatgcttcttagaagttattggcgaaacagagatcttgattgtaggactaacttgagtagcttttcaaaatagttgcaaacacaatgtatggattgacacatccatatattgaaa

SEQ ID NO: 15813 - DNA, 302 bp, Homo sapiens
atctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaaaaaaaaaaaaaaaaaaaaaaaaaaaaa

SEQ ID NO: 15814 - DNA, 508 bp, Homo sapiens
catacacagactgatattaaccatccaggtaaattgaacgacaatgtcggcattaggtatttggctgtctattgtggcgctaaatactatggctttgccatatgattgatggtaaaagagtgatgtcatattgatactagagtagcttgtttttttagtaggtgtgggaccatctcttttacaagtgcaactcaagtctaggacagccatggatgcagtgtctggagttggccctctgagcccgctggctgccccagtagcatctgcattggtgaccaaggacactgcactttgaagaggtcgccactgggttatttaagtgtcttcactgcttttgttaaaaattgtaaaattttgtacacaaaaagttgtgtttttgaatatcaattgtttagacacacctacaatgataaataagtgcctttaaagcccctctttccatgaaatacatctgtggtttagcaaggaaagtacaaaataagtttatgtagtggggataatttttatt

SEQ ID NO: 15815 - DNA, 102 bp, Homo sapiens
tgaagaagaatttatagatgtttaattcctgatttttgctccagaatatctttgagaatgacaacttaattaaaagatacttaggcactttttttttttttt

SEQ ID NO: 15816 - DNA, 287 bp, Homo sapiens
ctactctctctttctggcctggaggctatccagcgtactccaaagattcaggtttactcacgtcatccagcagagaatggaaagtcaaatttcctgaatgctatgtgtctggggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgacttt

SEQ ID NO: 15817 - DNA, 449 bp, Homo sapiens
accacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggattagaaaacttgttccatttattactattccacattctatcatgtaatccagttatgtcagaaattcacctctctgtctgttaaactgacgaccacggacaccttgtctcaatgttgtctgaagtcttactcgctgaaaggctttggttgactactactagtatctaagaaaaacattaagataaaagaaaagccagtgaaaaaatgagaaagcatttataatgatccaaactaattactaaatgaat

SEQ ID NO: 15818 - DNA, 343 bp, Homo sapiens
atcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaactcgaccaaaaatttgtcacagaattt

SEQ ID NO: 15819 - DNA, 359 bp, Homo sapiens
taatttgtgataggtgaagccagcagtagtcagtttgattacaaatttcggtgtaggtaggtgttctcataggttatgtgataaactaataaatgtagaggtaaactgcttgataaagtgggcagaatcatggactgtggtctattttattctttacaagtttcaactgaaaattactaaatagaagcttattcgttgacataaatatcaagatcttctataggaccctaaattgtctagcttaatagttctttaagaagagtgcttatcatctctaaccctgtatatttgtcaacatgtcccagctaaccaagaagaaatggtttaaatcacaatttcttggccctattgacattttg

SEQ ID NO: 15820 - DNA, 439 bp, Homo sapiens
aacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaa

SEQ ID NO: 15821 - DNA, 390 bp, Homo sapiens
agatacacatcctgttattatctgagtttctcagactctaattctggcaaattcttaatcatctctagagagatttatttatttccctttctgagaatcttattagatattgacatttaaatattttaaccatgtctcatagcttttgagaagtgtttatattttctacttccttattcctttgttaatgcttagtagaattgcttgcctgaactcgttgctcactagtatattcttgccctatattcaatttgctaggtaacccatcggattttttatttcagcaggttaaaaaatctatacatatcttcaattggtgaatattatgttggtttaaattgtgggctctttagtctttttcttatgggattgatggacatcgggggcttt

SEQ ID NO: 15822 - DNA, 341 bp, Homo sapiens
ggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtt

SEQ ID NO: 15823 - DNA, 485 bp, Homo sapiens
gacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtctt

SEQ ID NO: 15824 - DNA, 361 bp, Homo sapiens
catcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtc

SEQ ID NO: 15825 - DNA, 469 bp, Homo sapiens
aaaccagctgaagaacagcttgatgtgggacagtctaacgatgaaaacatacatacatcacatattacccatgacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccacctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaactattcccttaaaaggcagaagacagca

SEQ ID NO: 15826 - DNA, 373 bp, Homo sapiens
gaggatggaaagggacatacataactcaccagctacacagacttgcaactcattgcagccctgagctgtcccactgggagccaagtgccttcagcaggcgttgagaactctcacagcaggaaaggacatagcctgagaggatggaggcactgaccagaacactgcgtttgtggggactgagtgcacgcacccagggccgttggcaaggccctaagactaaactcaaacctaacttggttttgttcttgttgttcggtttattattttgttttcttttttcttttcttccttttttctttttttaaatattgaagtggggagggagggaagagaaggaatatgaagcataagtggtttactgaagttttgtgtg

SEQ ID NO: 15827 - DNA, 230 bp, Homo sapiens
gaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaaaaaaaaaaaaaaaaaaaaaa

SEQ ID NO: 15828 - DNA, 499 bp, Homo sapiens
attgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggaccgttggccctgtttgctttttataaaccaaactctatctgaaatcccaacaaaaaaaatttaactccatatgtgttcctcttgttctaatcttgcaaccagtgcaagtgaccgacaaaattccagttatttatttccaaaatgtttggaaacagtataatttgacaaagaaaaatgatacttctctttttttgctgttccccaaatacaattcaaatgcttttttggtttatttttttaccaattc

SEQ ID NO: 15829 - DNA, 420 bp, Homo sapiens
gtctccgaagattcatgaaaagcaaaatggtgcatatcacgattttgaccaaaggagataataatgcgctgatgaccgaagcctctattaacaaggaccaccattggctagaaaaaaaaagaatgttgtgggggagaacccaagggaatttggtcccttatattggaattgtgacgatccctcatgaatgactatcctaaattaagtatgcagtctcttttttgctgggtttattcgtgctggtcatcgtgaagtaagaagcctgccttgctgttcctgggaagatccatagttttcggtactggatgtttggagtagatctggctgtgattggtggaatggagaacacacgtgttggtgctctgggtagcactggtttgcattaagttatgttccatgccagagtttgtgtgggcgggc

SEQ ID NO: 15830 - DNA, 362 bp, Homo sapiens
aatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatag

SEQ ID NO: 15831 - DNA, 361 bp, Homo sapiens
gtatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctg

SEQ ID NO: 15832 - DNA, 530 bp, Homo sapiens
gggtacaaaattgtttatttgccttttctttgtttgtaacttatctgtaaaaggtttctccctactgtcaaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgcagcatgttgttgttgaagtgtggagttgtaactctgcgtggctatggacagtcaacaatatgtacttaaaagtgcactattgcaaaacgggtgtattatccaggcactcgtacactatttttttgtactgctggcctgtccagaacattttctttaattgtacttgcttttaaacttgttagccacttaaaatctgcttatggccaattgcctcaaaatccttccaag

SEQ ID NO: 15833 - DNA, 328 bp, Homo sapiens
ggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctc

SEQ ID NO: 15834 - DNA, 340 bp, Homo sapiens
aaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcag

SEQ ID NO: 15835 - DNA, 238 bp, Homo sapiens
cccttgaggccaagagttcaagaccagctgagcaacatagcaagacccagccccacacccatctctaaaagaataaaaaattagctgggcgtggtggcttgtgcctgtggtcctaactacttgggagattgaagcaggaggatcgcctgagctgaggaatttgaggttgtaataagctatgatcatgccactgctctccagcctgggcaacagagtgagaccgtatttctcaaaaaaa

SEQ ID NO: 15836 - DNA, 463 bp, Homo sapiens
gaagtaatcaataccgctcagtattttaaatgaagtgattctaagatttggttcgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttaagtatgcagttgataagaggaatttggtataattatggtgggtgattattttttatactgtatgtgccaaagctttactactgtggaaagacaactgttttaataaaagattacattcc

SEQ ID NO: 15837 - DNA, 316 bp, Homo sapiens
gaagaatggagagagaattgaaaaagtggagcattcggacttgtctttcagcaaggactggtctttctatctcttgtactacactgaattcacccccactgaaaaagatgagtatgcctgccgagtgaaccatgtgactttgtcacagcccaagatagttaagtgggatcgagacatgtaagcagcatcatggaggtttgaagatgccgcatttggattggatgaattccaaattctgcttgcttgctttttaatattgatatgctatacacttacactttatgcacaaaatgtagggtataataatgttaacatg

SEQ ID NO: 15838 - DNA, 214 bp, Homo sapiens
cgataatcaaaccaaggaagcaatctgtaactgctgctcggaacactaaaaccatatatattttaacttcaattgtctttagcttttaccaacccaaatatatcaaaatgttttatgtgaatgtggcaataaaggagaagagatcatttttaaaaaaaaaaaaaaaaaaaaaaaaaaaaaaaaaaaaaaaaaaaaaaaaaaaaaaaaaaaaaaa

SEQ ID NO: 15839 - DNA, 440 bp, Homo sapiens
  misc_feature 353: n = A,T,C or G
tatgtagaaggttaactttcatttataatataagtggtgcaggggttcaacattttaagtaaaaatatttttacacactacctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgttccttaaattattggggaaataatggattactagatatattgtaaaccaatagatcctggtatncgataaaatatcagctcattggaggctgaacaattattcaagtgccccttattaacaaaagtatcagtggatccaacataaaatctt

SEQ ID NO: 15840 - DNA, 473 bp, Homo sapiens
cctgggcaatagagtgagactccatctcaaaaaaaaagaaaaagaaaaaaaaataccctttcaaacaaatagactttcaatcatacaaagctttttctctaggacctagactaaaatgttatgaactaaaagaaaaaattactgacaaattggctggctcattcaaataaatcagtttgaaaggattatagattaagctgacagtttgagtattaagagaaaaatgaaagaaggttgagttttgaaaataattttagaataagagtaagaaattccatgtatgatataattttttgacattataaagcagaaataaaataatagcttgtaattcttatatagggcatgaggtggtgctgtattctaccaattcaggtaaattcatataagtgcaaactgaactgttatttcctttatttgcatatacaaattttacttattttcattcataatatataacgaaatgctgaaag

SEQ ID NO: 15841 - DNA, 608 bp, Homo sapiens
gacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccccaattaagaaagcgttcaagctcaacacccactacctaaaaaatcccaaacatataactgaactcctcacacccaattggacccaatctatcaccctatagaagaactaatgttagtataagtacatg

SEQ ID NO: 15842 - DNA, 360 bp, Homo sapiens
aagtatactcagaaattgataatctgaaagtagtaatttgtagactatgaaaccatagaaaataatcttctggtttaaaaaaaattagagggttgtttgaaaaataacatgaattttgcatataaaaaaactgaaaggttttgcaaaatacagtatttagcggttacaaacagtgcaggaaaataagaagtctacgagctttaagaaatgtagaagattacttggaaagacatagtatgtttgtagatgataagactgagcattataacgtgtcagtctttctcgactacgtttcttgaaagcagttttccaggtaattttttagtgttcatttggaagaatgaaaggtaaatagtgaaa

SEQ ID NO: 15843 - DNA, 300 bp, Homo sapiens
gaaaatctaaataaaaccatttaaaacataggcatgagcaaatattttgtgataaaattgccaaagcaattgcaacaaaagcaacaattgacaaataggatctaactaaactgaagagcttctgctcagcaaaagaaactatcattagagtgaacagacaacctacagattgggataaaatttttgcaatctatccatctgactaaggtctaatatccagaatctacgaggaacttaagcaaatttacaggaaaaaaaataaccccattaaaatgtgggcaaaggacatgaacacatttt

SEQ ID NO: 15844 - DNA, 393 bp, Homo sapiens
gaggcattgaggcagccagcgcaggggcttctgctgagggggcaggcggagcttgaggaaaccgcagataagatgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtccaaaaaaaaaaaaaaaaaaaaaaaaa

SEQ ID NO: 15845 - DNA, 341 bp, Homo sapiens
attttatctcatgtgcatgtgttttgttgtttaatgtgcaaaaacataatgcatagaggggtagcattcatcagaataaggtcagaaaaatggaggactccagtgttttttgcgattgctttccgtgtttatgtgtgtgtgtgtgtatgggcgcacgcgcatgcatgcatgtgcacacttgtatctgtgtttctgacatatgggcaacaggtctactgcaggctggactccctctctgtaggctctagggacttctccataagaggatgacctacttgacctatttttgcaagtatcttttgccattttcctaccctctgcttccctactcccatcagtca

SEQ ID NO: 15846 - DNA, 318 bp, Homo sapiens
cattgatcacattccttcccacctcaaaatgtggttttaaagcaattccctttctccaggaaacatggccaaaatcctttttaatttttatacatttgccatacctttcaagctaatagtctattttcaaacatttgtattctttactttttctgttgttatgatctcttactaggtaataagaatcttgagggtaggaatttgtcttccctaattttttataccttcatgttgttcaatgctgaacaaattctaaatactattgaagtataaccaattgtttaagtaggtaatagtgatcttgaatctttttattga

SEQ ID NO: 15847 - DNA, 525 bp, Homo sapiens
atctgatacacagaaaagagaataacttgactcaaaggcacacagcctgtagaattaagatggaatctggctttgggacttgctctccatcaaccccttatggactgccccacactgattggggaatcatagagaaattgtaacaggtcacatttcacccacagtaaggagccccctccgctaagcctggcctcccaagacacagtacattttccctttcgtgatttaactagtaatttcattaggttaaaaacatcatctccttttcttaccttgaagccaggacttctactgaggtaaatggtgtgagggctgcagcttcaagaatcaaattgaaagtgtcacaaaaagaaagctggtaaaagagtaaaattggactcccacctcacacacatacaaaattaactcaaaatgggctaaagacttaaatgtgaaagctaaaacactctaagaggaaaacagagtaaatctttgtgactttggattaggcagtggttttatatataatgccaaaaaacacatgcc

SEQ ID NO: 15848 - DNA, 475 bp, Homo sapiens
gaggcattgaggcagccagcgcagtggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgatt

SEQ ID NO: 15849 - DNA, 136 bp, Homo sapiens
gatactaaacaactctctgaaatttctcaagcaccaagagaaacatcattttagcaaaggccaggaggaaaaatagaaataaatttgccttgaagacctcattgatgtgatgttacattccctttaatctgccaac

SEQ ID NO: 15850 - DNA, 305 bp, Homo sapiens
ggagagagaattgaaaaagtggagcattcatgacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgt

SEQ ID NO: 15851 - DNA, 488 bp, Homo sapiens
gcttttttgtccgacatcttgacgaggctgcggtgtctgctgctattctccgatcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcc

SEQ ID NO: 15852 - DNA, 326 bp, Homo sapiens
tttcagtttagctacggcaatcctgagcttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatat

SEQ ID NO: 15853 - DNA, 473 bp, Homo sapiens
gaagtgaaatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttggtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgttttactttaaagtgaatgtttttctcttcagctgatctaaaaatgaaagcaaaatatct

SEQ ID NO: 15854 - DNA, 497 bp, Homo sapiens
attgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaaagaaagttaaggttaaggctggagttgtctttaa

SEQ ID NO: 15855 - DNA, 165 bp, Homo sapiens
gtttgggatgaaataactatctccccttcctctgtcccccaactggggagtctccccaggctgcttttctaggaataccagtcacataggttttatttttgtgtctgcgaaagtgccaagaacccctccccacatttgtagatccatgaccctttttataagctg

SEQ ID NO: 15856 - DNA, 480 bp, Homo sapiens
ggacgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatggtaaacttacagatgaaccttgtgtttcagctttttcttt

SEQ ID NO: 15857 - DNA, 470 bp, Homo sapiens
  misc_feature 454: n = A,T,C or G
tatattataaaatattatttgatttcagacgaacactttcaccttattttctagatgatctacgtctttactctgtaactactacctctaaatcgagccttatttataattgtcctatgaagttatattgtatcattctgtggctgttgcagtatcatttaattgctttgtaaaacgctacactgcaacacaataaaatacttcaatgcttacaatcggaagtcttgaaatagtatcctgacatggtattagaaagcttatctgcagaataacacaaatgcccccaggaatggggagggatgagggcggcccagagaccagaagagctttggttttatgaggagaaagaagggaatcacgctactcttggtgactctttactccaagtcattcttcattgctaatggctcccaataggctaccttaggattgattcccagaaggttctggtggnttattagaaggtaaat

SEQ ID NO: 15858 - DNA, 328 bp, Homo sapiens
tgacattaacaaacctaagtatcgtccaccataaccccatcgggctctcaccccatttcttcataagttctagagcatcctgagctctttcctattacccttgatggtactcatggtctaataccccccgcagttataggtccttatggatcctatgctaccaccggtctaatcccttctatcactcgtcctacttgttaatcaacaccctatcccatacttaaatactatcccggtcctgaagttgttgttcgacatcggtaccccgcagacgcggcccgatcaccctcgcacgctcttactcaccgacgagggctccaaaaaaaaa

SEQ ID NO: 15859 - DNA, 533 bp, Homo sapiens
agagaaagaacccaagagaactaaagttatgtcagctacccagacttaatgggccagagccatgaccctcacaggtcttgtgttagttgtatctgaagctgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaag

SEQ ID NO: 15860 - DNA, 308 bp, Homo sapiens
aacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacaccc

SEQ ID NO: 15861 - DNA, 543 bp, Homo sapiens
  misc_feature 2: n = A,T,C or G
gnaggagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagcactcttaattaatatctgtatcctggaacaatattttatggttatgtttttctgtggtcagttttcatagtatccatattttattactggttattacttccatgaattttaaaatctgagggaaatgtttgtaaacatttatttttttaaagaaaagatgaaaggcagcctatttcatcacaagaccacacacatatacacgaatagacatcaactcaatgcttattggaaattaggggttttttattctactgcaaatgagtgcaaacctttactggtgctggaaatcagccaagtttataacct

SEQ ID NO: 15862 - DNA, 422 bp, Homo sapiens
ggttggggcgacctcggagcagaacccaacctccgagcagaacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtataatacccacacccacccaagaacagggtttgcc

SEQ ID NO: 15863 - DNA, 356 bp, Homo sapiens
cccagccctgacttgaaaccattagcgctaacttgctctgttttgagaaaaactttccaaacttttgcatgagaaactagaaaaaggaatgtatgccacgtaactggattacagaaatgagttaattgtctctgtgataaaaaaaaaaatgaaatattttcttattgaattaatatttttgtcttgaagcattttctagtgatagaatgtatttgtcttttttcctggtggtaccctcttagcatatatctttgctatccttaagatcctaaacaaatcatctttgtcagttaagtatagttgcgcaaaaattgttaaatcctttgtctttattaaagaaaaatttgagtaacctt

SEQ ID NO: 15864 - DNA, 493 bp, Homo sapiens
gaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgtaggaataaccttgctgataagaaaaaaagggacaatattggagaaactacctcttgttaattgatctgtccactctgaga

SEQ ID NO: 15865 - DNA, 280 bp, Homo sapiens
attagcctaaacaaattaatgaaggaagagaataccaaacaccacatggaagctaaacactgagtgaacatgaacataaagtagccataataaacactgggcactcctagatgggggagggtggaaggaaggtgtgggttgaaaaactatcaggtactatgattactacctggatgactggattatccatacagcaaacttcagccacgtgcaatttacccatgtaacaaacatgcacgtgaacccccgaacctaaaataaaagacttcctacaaaaaga

SEQ ID NO: 15866 - DNA, 556 bp, Homo sapiens
tctttaagccctttactatgcactgtagctgttacttttgcagtctgaagtgcaacagcaaaactcacacaaatttatctttcccttttcacaagttcacatatagaagatttgctcttaccctagatcttcgccacctcaacgtatgatctttcctttggttgagaaattttttcttttcacttaaaggaaacgctttatggcttctctttggcatatctgaattgctagcatcactacttttatactttggtgccattataaagtaaaataagggctacttgaacagaagcactgcagtaccttgtcagtcaatctcataaccgagacagctaccaagtgactcacaggtgggtagcatggatagtggggatatgttggacaaagggctgactcacatctctagtgggacagagcaaaattgtactagagtcatcacactactcaatttaaaacttatgaattatttattcttaaattttcatttaatatttttggactgtgattgccttggtagctgaaaatgcaaaaagggaagccccagataaggagactc

SEQ ID NO: 15867 - DNA, 328 bp, Homo sapiens
gggttcacattggccaagctatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttctgtccaaaaaaaa

SEQ ID NO: 15868 - DNA, 328 bp, Homo sapiens
gatttagaaaattaaatgcactagagaccaggggtgtgcacagagacacaggcccctcaccgaggcttgcatgctaacagagactgttggcttttctttcccagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcaaaaaaaaaaaaaaaaaaaaaaaa

SEQ ID NO: 15869 - DNA, 534 bp, Homo sapiens
gctctcttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgcggctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctggccccaaaagagctagcagaatccgcaaacttttcaatctctctaaagaagatgatgtccgccagtatgttgtaagaaagcccttaaataaag

SEQ ID NO: 15870 - DNA, 216 bp, Homo sapiens
gatagctggttgcccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 15871 - DNA, 436 bp, Homo sapiens
ggcactgataaaatgaggcctagtcctaaggaacaaaaataattaaaatgctgtatagtccatggtgcaaaacaaaataagaaatgttgacattgtttaaaaaaccataaagttgtgcattttaagaaacacaatgctttgtaatattccctctgaaatcagaaatgtagtgaaagtacagttttccaatctagaatgctatgattctttttattactagtgttttataagtcacgaattaaatatctatagatgagttagcgatcttgattatttttaccctagagttttatcgtacatgtaaagtacctagtagtttcagtttattctaaaatggataagaaattgttatgcattctaatttgacagccgtctcattttgatactaagttaaattaccatgtattttccctattattcatcatacatctatggg

SEQ ID NO: 15872 - DNA, 361 bp, Homo sapiens
gctgaacaaacaaaaacaaaaaaaggaaagataaccaataggctttttatttaattgaaaaccaaagagagagagaggaaagaaccagttagttgccattttctaaatgcaggcttttgtttgtttctgccttctaattctttgctcttgaagctatagctttcaagcttgtgtatacaggcccagagagaacatttgaaatgtggccaccctacccatgtccatgccactcttcctgcctttctctctgcctacttctgctccaccatcccaggtcaggggcttggaggctgacagcattacaagtaatatagtcgttcaagctcatataaacaagatgaaatccaaaaaaaaaaaaaaa

SEQ ID NO: 15873 - DNA, 468 bp, Homo sapiens
  misc_feature 421: n = A,T,C or G
tggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagcaaatgccaaacactagctctgtattaatccccatcattactggtaaagcctcatttgaatgngtgaattcaatacaggctatgtaaaattttactaatgtcattatttt

SEQ ID NO: 15874 - DNA, 523 bp, Homo sapiens
gatcttaattttggtaccagttaaaaatacaaatgtactatattgtagtcattttaaagtacacaaagggcacaatcaaaatgagatgcactcatttaaatctgcattcagtgaatgtattgggagaaaaataggtcttgcaggtttccttttgaattttaagtatcataaatatttttaaagtaaataatacggggtgtcagtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgattacaaggcaatgctaccttctttattccccctttgactacctttgaagcactatgagcacatggatagaaattaacttttttttgtaaagcaagcttaaaatgtttatgtatacataccccagcaacttttataaatgtg

SEQ ID NO: 15875 - DNA, 342 bp, Homo sapiens
agcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctgggaaaggtcagaatttcatcttcatgttgaatttcccttttaacttccggtcatagaca

SEQ ID NO: 15876 - DNA, 245 bp, Homo sapiens
ctcaaatatattgacatcaatgttcatataaatcatgtattcaaaatctagggtattttaaataaatatttaataaagtttgcttttctctctagatacatgtgatttttttcttctaataaaattatagcaatgtaaagggaaggaataagatatacatgactaaaataaagtagcatggtcactcgataccattaaaagtaaaagctggacagtttttagagttaaattagtagtaccagctg

SEQ ID NO: 15877 - DNA, 210 bp, Homo sapiens
ggagtttgagaccagcctgaccaaaatggagaaaccatgtctctactaaaaatacaaaattagctgggcatggtggtgcatgcctgtggttccagctactcaggaggctggggcaggagaattgcttgaacccgggaggcggaggttatggtgagcagagatcacgccattgcactccagcctgggtgacaagagcgaaaccctgtctcc

SEQ ID NO: 15878 - DNA, 371 bp, Homo sapiens
attgagccggtgcccatgtctcacatgacatccagccccgacagggaggggaggtgaaaaagccattgtcggccgggccgtggtggctcacacctgtaatcccagcactttgggaggctgaggcaggcggatcgcctgaggtcaggaatttgagaccagcctggccaacatggtgaaaccctgtctctactaaaaatacaaaaaattagctagccgggcgtggtgatggatgcctgtagtcccagctactcaggaagctgaggcaagagaatcacttgaacccaggaggcagaggttgcagcgagccaagattgcaccaccacactccagcctggatgacagagtgagactccatctcaaaaaaaaaaaaa

SEQ ID NO: 15879 - DNA, 373 bp, Homo sapiens
gattgctgaaactgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaag

SEQ ID NO: 15880 - DNA, 634 bp, Homo sapiens
aaataaccaggcaacagagggacaagacaataccaagaacagacctacggcagatacaaacattatgagctatcagacacagacattaaaataactgtgcctagtgcattcatagaaataaaagacatgaattagaactttggcatagaactgggaactaaacaaaatccaaatggacattctagaatgaaagataaagttcctgaaatgaagaattcattggttgggctcaatagcaaattagacacaacagaagaaaatattagagacttggaacataggacagaagaaaatatccagagtgattcccggagacacacaaaaaaagacgaaaagtgaagaagagagggaaagggacatagaggaggtaagaaggtctaacgtgttgttggaatctcaggtcaggagagagagaaaacgagtcacaaacaacatcccaagagataatggccatcacttccccagagtagcaaaagacatcaagccgtagattcaagaagctccaaaaaccccaagcaaggaaaataaaaagaaatccatactcaatattgctgaaaaatcacagatagagaaaatcttaaaatcggctggaggaagaaaaatcaaaaaaaaaaaaaaaaaaaaaaaaaaaaaa

SEQ ID NO: 15881 - DNA, 453 bp, Homo sapiens
  misc_feature 52: n = A,T,C or G
ataagttgactccacagattctgattttgctgtgttatcttgcgagtaatgntgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagccatttctttttagagttcaaagcagttctgttacttgccataagttcctcataaattgcccaaaggtaggacatggaaataaatgtatatctttatttttaatctactatgcacactctggtgatattcatggacattaaaaaagcacctatgttattttataattaggaaaatgaaggagaaaatggtcttttgaaattttagg

SEQ ID NO: 15882 - DNA, 300 bp, Homo sapiens
  misc_feature 11: n = A,T,C or G
tctaaattttnctacttgaattccttttaaaattttctttggcagccgggtgcagtggctcccgcctttaatcccagcactttgggaggccaaggcgggcagatcacgattgtcaggagataaagaccatcctggctaacacggtgaaaccccgtctctaataaaaatacaaaaaattagctggacgtggtggcggcgcctgtagtcccagctacttgggaggctgaggcaggagaatggtgtgaacctgggaggaggagcttgcagtgagcctagatcatgccactgcactccagcttg

SEQ ID NO: 15883 - DNA, 300 bp, Homo sapiens
  misc_feature 31, 99: n = A,T,C or G
cttcaaaattccaaatggaaaaccaaaagangatgaagcttaatgttttgactccacagagatgtttggggctacctgagtaatagttttgaaatgggngtttctcttaattgtagtattttatttaaaccctaactgtggtagggttaatatgaagacacataggtactagggtgactggcaggacaaggaggcatagaaattactggtcaagggcggggctcagtggcttacacctgtaatcccagaactttgggaggccaaggtgggcagatcacgaggcaggagttcaagaccagc

SEQ ID NO: 15884 - DNA, 176 bp, Homo sapiens
tctgcgccctaaatgcccatgcctaacttgcttctctagtttattccttctgtggagggattaaaacgtgggtgttgcaagttgccctaagctaaacatagttttcttacatctttttgggaaaaaaaaatggaatgggaagtatgcaagattaagcaagagtgattttttttttt

SEQ ID NO: 15885 - DNA, 396 bp, Homo sapiens
gaaatcttttggttggagctagtttaaaaaaaggagaaaacatgtcttattgactcacaagtatttgaaacattgtaatatcaactttagaaggttcttaaaatgaagaaaagtggaaaagatggttgttttgccttctacacattgtcaaaataggtgttttcatagatagatagatatgatccagtaactaaaagcctaattaaaatttgtttaaagccaggggggcatgtttccttgttgacagcagcagatcgattgggtaagacaatagagtcccattattttacttccattgactgaacatattgacatttcaggtttgctgttgcctcagtgagcatgatgaaacactgaaattcacagaccaactggccagagtggcacatattactg

SEQ ID NO: 15886 - DNA, 536 bp, Homo sapiens
gatgttagctattattactatccacaagaatgggacatatcaattatatatattactggcctagtaattatatatacttagaatccctgatcaataaaataaattgtaatagaaatttttattcctcaaacacatttttgttcctcaaacacatttttaaataaacatgtcttgggaaagccaaagaaaaaaaaatcatacctatatccaaatatgttatattaaaaccttgttccttggcaatttcactaagcagctggatgtaatctgtatttggaatactaaggaggcttcttttcagtaagttgatcttttcaccaggagaattcctcaaggaatgccaagcccatcctaaagaatgcctactacatttgtctgaaaaacagagatgaagatttagactcttgactagggactgggttcaacacccgaccagtatcattaaaagacttattaagccctcacatttaatatggtataaagcatggttaaatggataacatttgggtaattttccaatttaaccaggacaccat

SEQ ID NO: 15887 - DNA, 517 bp, Homo sapiens
accaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagacccacacatatacacgaatagacatcaaactcaatgcttatttgtaaatttagtgtttttttattctactgtcaaatgatgtgcaaaccttttactggtgcatggaaatcagccaagttttataatcct

SEQ ID NO: 15888 - DNA, 441 bp, Homo sapiens
aaattaacaatctgacagtgcacctcagggagctagaaaagcaaggaaaaaccaaacccaaaattagcagtagaaaagaaatagtaaggatcagagcagagctaaatgaagtagagactaagaaataaaaaatacaaaggatcaacaaaacaaaaagttggttcttcttcaaaaaggtaaacaaaataggtaaaccactagctagactaaccaagaaaagacccaaataaaaccagaaatgaaaaaggaggtgttacaactgatcacagaaatatgaaagatcatcagagactattatgaacaatgatatgcccaccaactagaaagcctagaaaaaaatggataagttcctggaaacatacaaggttctgagattgaaccaggaagaaatagaagtcctgaacagaccaataacaactagtgagatcaaatcagtaattt

SEQ ID NO: 15889 - DNA, 469 bp, Homo sapiens
cactatacatgagggccattaaactgaaatcaccaacaggaagcacaaaaatgtgaaaaacatggcactaaatactgtgaaaaggacattgtttgtaataggagagctgaaggaagaaggctgagtgacaccttgttcagcctcatgtgagaacatgggcatcagtttattcaaatttttttgctgctctatgcctgcaaatgacccctaaagcacccagattttttatcacaaataattttaggtgagtaggtgaatttgcaaatacagaatccatgaataatgaagattaaatatgttagctgggcatagtatttgaaaattatttgtagaaatatgaagccttgagttgggcatggtggctcccatggtaatcccagcactttgggaggctgaagctggaggatcacttgagactaggagtcaagactagcctggcaacatagcaatatcctgtctccatgaccaa

SEQ ID NO: 15890 - DNA, 194 bp, Homo sapiens
gaaatctctccctgatacatgacatttaaccacctttatcctgtaacatattcattctcaatgactcctttgaaaatttggataacttcattgacatctttaaaataagttagggaatttaaagattttcagtagcttctctctcaaatatgtttatccctaaggaaaaaaaaaaaaaaaaaaaaaaaaaaaaa

SEQ ID NO: 15891 - DNA, 366 bp, Homo sapiens
gctaggactcagagaccagcagatgtgatatttgccacccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcaggtgatgcctttgaggggaaggaggagcccctctttctcccatgctgcacttactccttttgctaataaaagtgtttgtagattgcatcttct

SEQ ID NO: 15892 - DNA, 461 bp, Homo sapiens
atgttaagacgtctgtaacaattacactttggtaaaattgttggatgttaacatctctgatagctcccaatagaaatctctgatgtactaaccagactgataaaccattatcatgcactttgaaaatataataaaatattataattaaagctgccattaatgaaataggctgagcaacaataaatttacaaaggaaaataaaagtggatagccttgggagttctcacataaaatatggagatttcaaagttaaacttgattaattatgttagggtaaaaagtgaattaaagcaacaggactatttataaaataattagatttagaaagtagtcgtagaaatataagcctggagttgcctctgaattacatatttaacaatcctagaagctaaatcagtttgtcttttatcaaaactgcactcctctaagttgaaagcacagtgacaagagaaagcattacc

SEQ ID NO: 15893 - DNA, 361 bp, Homo sapiens
gcttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaagggtaagctggctgtcctgaaatattataagg

SEQ ID NO: 15894 - DNA, 349 bp, Homo sapiens
tatttaggataaaaagcagagacataaatgctacaaacatatatggtattagaatgattattacatttatcctatcaggttttgaagcagtattattgccttagtttcttgcatcaatttttctcttcatttttccatcttatctctttcctttcacagaatggtttgatgaaattataggcactaaatcatttttaattacagatctcttgaaaacatatcatctcactaaacttcgaggcaaaatgaaaatgtgtgattatcccaatttattagaacttttgtagctgtcttaaatttttacagatagaggttgaagttgccattacttagtgaagagtcattgccg

SEQ ID NO: 15895 - DNA, 333 bp, Homo sapiens
actgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggtaggaccaccacacttggtccacttacttacaataaacattgatttggtcgttcaaaaaaaaaaaaaaaaaaaaaa

SEQ ID NO: 15896 - DNA, 520 bp, Homo sapiens
gggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaat

SEQ ID NO: 15897 - DNA, 359 bp, Homo sapiens
gtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatact

SEQ ID NO: 15898 - DNA, 570 bp, Homo sapiens
cagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcagggaaggaaagaacttgcatgttggtgaaggaaagaagtggggtggaagaagtggggtgggacgacagtgaaatctagagtaaaaccaagctggcccaaggtgcctgcaggctgtaatgcagtttaatcagagtgccattttttttttggtcaaaagattttaattatggaatgcacaattttttaat

SEQ ID NO: 15899 - DNA, 530 bp, Homo sapiens
atctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagagggaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagatac

SEQ ID NO: 15900 - DNA, 357 bp, Homo sapiens
cagtattttaaattttgcatttttgtattgttatatcttacttttttaaaaatatttttgatccatgcctgtttgaatttgtggttgcagtaggtcaactctatacaatgtattgttattagctgtagcaccatgttgtataatagatctcttgaacttatttcacttaactgaaattttgtgttctttgactaacatctctctactttcttcacccacccgccccagtccctggaaaccatctttttactctctctctatgagttctacttttttagcctctgcatataagtgagatcacgcggtgttgtatctctgataagatttcttgtgtggattggaaagcaggaaccctta

SEQ ID NO: 15901 - DNA, 595 bp, Homo sapiens
actgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttgggaggaagaagagctgagaaaagccattttagtgggtgttttgcaaataaacaggcatggacaggccatgacttcctcagagatggcaaaattcacttgggttacctgccttgaagggaccgaaaaatggcagatattcaaaaacgcagccaaccaaaggcccccggccttgata

SEQ ID NO: 15902 - DNA, 463 bp, Homo sapiens
ggagattgtttattctgccttatttccttcaccattgtcacctttgttaaaagtttccttcagatgaatacataagaaaaatccaaatccaaaagcgccatttcaatttttggtatttaataagattcttttctggcaaagaattcaaggtaaaagatttttatacacactttagtattacaactattttaattattactagtaattaaaacctctgttctgtgcatactgttttttccaagaaaccctcttattataataaaatcttgagtcatttcagctatgtgcaaagttgataaagtcactgactgaatttttttaaaaagcttgatgcttaaatgcttaaataaatgcttaaatctacttttaagcatttatgtcagtgaattcaaaatactattatctttaaatcactcaaaacccattttaaacttgtatgcctttactcagttaggtccaatgg

SEQ ID NO: 15903 - DNA, 340 bp, Homo sapiens
acactgagtataccaaactgtggactccattattacagtctttgattggtctttttgagttacccgaagatgataccattcctgaggaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgct

SEQ ID NO: 15904 - DNA, 509 bp, Homo sapiens
cacaggtggtaaatgagggaggagccaaacctgaacttgcaagtcaagccacagaaggatccaagtcaaatgaaaatgacttctcataggaagtcatttggtgttggaggtgggtttctcacctggggctctacgagatgttgctggggctccaccttaaattgtgactaaaaacagttttttatttgtgtgctgcattatgctgttctcacagtagtgagcaatgattgcgcagccctgttaacagtttttttagggatctttcagcctttatggtattacgtagaggcagacccatgtgctgctgttgcaaagaggggaggataggagggggatgttgcctctcccaggctcctcttctgcagtgccagctgacttaagggagtgaactacctgtgaagtagaaaatcagagggaagtttcattctgaggaaggagtttttacatgccacagctcagctgtctgcctgccactttgttgtaaacattgcaaaaatgtggatcatgta

SEQ ID NO: 15905 - DNA, 254 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaaaaaaaaaaaaaaaaaaaaaaaaaaa

SEQ ID NO: 15906 - DNA, 427 bp, Homo sapiens
atttgaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaattttggttgttttggttgtttcttaaaaaacaagttaaaacctgacgatttctgcaggctgtgtaagcatgtttacctgtggc

SEQ ID NO: 15907 - DNA, 522 bp, Homo sapiens
aggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcacatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactcc

SEQ ID NO: 15908 - DNA, 559 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaggcgatcttttaaaaagagattaaaccgaaggtgattaaaagaccttgaaatccatgacgcagggagaattgcgtcatttaaagcctagttaacgcatttactaaacgcagacgaaaatgg

SEQ ID NO: 15909 - DNA, 228 bp, Homo sapiens
tcatggaaataaaaagacaaatctgaaaaccagtactgatgaatcaacaaattaattttgaatatgaatgacaagtgtaccaacgagatggatatcattatttctaaaaaagccagaactgctagaaaataaaaaattattgaaggaattaaacaagacagttgaaagcttcaacaagagactagagcaagcaaagcagagaatctcactgcttgaaacaaatctttt

SEQ ID NO: 15910 - DNA, 519 bp, Homo sapiens
ggcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccatggctatttaaaacttgtaatttttttaatttacaaaatataaaatatga

SEQ ID NO: 15911 - DNA, 494 bp, Homo sapiens
atgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacaccctcaacaaaatctaatttaaaatgg

SEQ ID NO: 15912 - DNA, 343 bp, Homo sapiens
ccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagcct

SEQ ID NO: 15913 - DNA, 508 bp, Homo sapiens
taaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagattcctctttccccccaacttttccacatttcttaaatgagggtgtaatttactgcaaacatgtacatttaatataatattgctgtaga

SEQ ID NO: 15914 - DNA, 361 bp, Homo sapiens
gaggcattgaggcagccggcgcaggggcttccgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatg

SEQ ID NO: 15915 - DNA, 599 bp, Homo sapiens
aaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacctttggaaattgaacaagaaatgcatctgtcttagaactggagattatttgatggtaggtaaaacatgtaattgttccctggcaaattggatcagtaattgaaaatgagatattaggaaaaccaatcttcttaaattaagtccatcttcttaaaagaacattaaatgtaccatttgtcagatcctgatttttggagcataaaaaggatgc

SEQ ID NO: 15916 - DNA, 299 bp, Homo sapiens
gggaagatttataggtagaggcgacaaacctaccgagcctggtgatagctggatgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccctagaaaaaaaaaaaaaaaaaaaaaaaaaaa

SEQ ID NO: 15917 - DNA, 315 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaaaaaaaaaaaaaaaaaaaaaa

SEQ ID NO: 15918 - DNA, 251 bp, Homo sapiens
aaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattg

SEQ ID NO: 15919 - DNA, 232 bp, Homo sapiens
aaaaagaacaagtccttttctttgaaagataaacaatgaaatatttatgggtgaaatagtgtctgggatttgttttaaaatatattaacacaaaaagtgtgaggaataaataaaatatgaagctgatggtttgctgacagatacattgggttccccgtactattcattcctttgccttaaaaataaaaacactcaaacaaaattgaaaaaaaaaaaaaaaaaaaaaaaaaaa

SEQ ID NO: 15920 - DNA, 181 bp, Homo sapiens
ctggaacacaagaagtgtttgtttaatgaatgacgtacacatttaaaatctgtttggacgcggaggataaccctgtgaattgctaaaagttcactgggtttggcccttagtgttgacttcagtatgctgagacggaaaccaacacgcctagagctaaagcttgatgacattgaagagtttg

SEQ ID NO: 15921 - DNA, 523 bp, Homo sapiens
aagaagctcctctgccaagaccaaaggaaagaagaaaaaggtccaaaagccaaaatgaaactgatggacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggaccaaagatctctttcgtgattccttgcaacaatcaatgagaatcttcatgtattctggagaacaccattcctgatttcccacaaactgcctacatcagtataactgcatttctagtttctatatagcgcaatagagcatagattctataaattcttacttgctaagacaagtaaatctgtgtaaacaagtagtaataaaagttaattcaatct

SEQ ID NO: 15922 - DNA, 319 bp, Homo sapiens
tttgtaaaattcctttcatcccagactttttatgattctgtagtacttactgttaagtcaaacacagttcttccttttttctgaaataatttctctttgtcttaaatccttaaagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgttt

SEQ ID NO: 15923 - DNA, 428 bp, Homo sapiens
gttccggggacgttgtctgcaggcactcagaatgggccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgt

SEQ ID NO: 15924 - DNA, 303 bp, Homo sapiens
gggcggcttcttcgcgctcgtggggttggccaagctctcggaggagatctcggctccagtttcggagcggatgaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtagcttgttcttgattctgctcatgatgggggctatcttcaccttggcagctctgaaagagtcactaagcacctgtat

SEQ ID NO: 15925 - DNA, 494 bp, Homo sapiens
ttcaacatgagatttggtgggtacaaacaaaccatatccaaatcatagcaggtatatattggacagcatagatactgaacattcccatcattgcagaaagttctgttgcacaacactggatagatcacattgtcaccagtttcccagtatatagttttctattattttcaagtatcctcccctcctgccaaaaaagtattgcttatatcctaagtctgtgattttttttccatactgaataataatcttcaaatttaagaagtcagtatttgaaatgattagcaagttagggttttagccgggtgcggtggctcatgcctgtaatctcagcactttgggaggccaaggcgggtggatcatgaggtcaggagttcgagaccagctttggccaagatggtgaaatcccgtctctactaaaagtacaaaaattagctggcgtggtggtgggcgcctgtagtcctagctactcaggaggctgaggcagagatcgcacc

SEQ ID NO: 15926 - DNA, 361 bp, Homo sapiens
agaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatcccca

SEQ ID NO: 15927 - DNA, 513 bp, Homo sapiens
cgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagaagtgcc

SEQ ID NO: 15928 - DNA, 550 bp, Homo sapiens
ggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgcactaaagactaaatgagggtttgcagttgggaaagaggtcaactgagatttggaaatcatctttgtaatatttgcaaattatacttggtcttatctgtgtcctaaagatgtgttctctataaaatacaaaccaacgtgcctaattaattatggaaaaataattcagaatctaaacaccactgaaaacttataaaaaatgtt

SEQ ID NO: 15929 - DNA, 362 bp, Homo sapiens
ggacaactcggtggtggccactgcgcagaccagacttcgctcgtactcgtgcgcctcgcttcgcttttcctcggcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactaccg

SEQ ID NO: 15930 - DNA, 241 bp, Homo sapiens
ggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattcttaaaaaaaaaaa

SEQ ID NO: 15931 - DNA, 446 bp, Homo sapiens
ataataaaaatattctacttatttttaaattatctatattatactgagtaaaataaaatttaggaatataaataaatgagcatttttgaacatgtaaaaatattttcttgctgtttttaggagacttttagcaggacaggagcttacctctcatctacctctgcttggacaaaccagtgatgtgatttgcaaataggctgtaacttcaccgaaaacacatcacagtaaagaaaggtagtgactttcagagaatttgacctaacttagaatttgtaaaagagaaaagcattgccttatgcctaaagtacatgactgtttctttttaagttacatgtatatttacctgaccaatttgttttactctgtattttaagttatcaggtgaaatggttttagaataaattaatgagttgtttcttctgaataaatgtgcatgttacaaatgc

SEQ ID NO: 15932 - DNA, 360 bp, Homo sapiens
atatgatttcactataattcaattacactattaacccttggcctactcaccaatatcctcacaatatatcaatgatgacgagacgtaattcgtgaaggaacctaccaaggccaccacactcctattgtacaaaaaggactacgatatggtataattctattcatcgtctcggaagtatttttctttgcaggattcttctgagcgttctatcattctagcctcgtaccaacacatgatctaggaggctgctgacctccaacaggaatttcaccacttaaccctctagaagtcccactacttaatacttcagtacttctagcatcaggtgtttcaattacatgagctcatcatagccttata

SEQ ID NO: 15933 - DNA, 537 bp, Homo sapiens
gtctcaattaagttgtgcctatactgatattatttccctagatccagaaactgactctattgaaggaaaaaaatctgatatcaatctttttaaaaggggaggaatgtgggagaaagcatgaaaatggctactgggaaaacttatttgtgttacctttctgaaggaaaatacatttttttattccttcaattgttgaacctttcctccaccctcaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagctgtgattt

SEQ ID NO: 15934 - DNA, 340 bp, Homo sapiens
cctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggcgtccttcataatgaagttaaagtgagtatactgtggagaggacttccaaatgtggttacctcagctatatcactgcccaacatcagaaaacctgacggctatgattactatg

SEQ ID NO: 15935 - DNA, 517 bp, Homo sapiens
gaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggttacgtgtattattttcaatatcttaataccctaataaagagtccataaaaatcc

SEQ ID NO: 15936 - DNA, 342 bp, Homo sapiens
tgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgcccaacaattatattactaccactgacatgactttcc

SEQ ID NO: 15937 - DNA, 591 bp, Homo sapiens
gtgaaggaaaaactttcttctttaaggattctcagtactggcgttttaccaatgatataaaagatgcagggtaccccaaaccaattttcaaaggatttggaggactaactggacaaatagtggcagcgttttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggccatgattactatgccttttctaaagatcaatactataacattgatgtgcctagtagaacagcaagagcaattactactcgttctggggcagaccttatccaaagtctgg

SEQ ID NO: 15938 - DNA, 280 bp, Homo sapiens
aatcccagctactcaggaggctgaggcacaagaatcacttgaacctgggaggtagaggtttcagtgagccaagattgcgccactgtactccagcatgtgccacagagcgagactcccatctcaaagtcactagggaggaagcctcattggtgggaaggaagaccaaattggaaatgctctgaggaatcattaaaacaaatgtccttttatcagtttggtggctcagggcctttagtaatactgccaaccatttttcctagagaaaaaaaaaaaaaaaaaa

SEQ ID NO: 15939 - DNA, 387 bp, Homo sapiens
tattcatcggcgtaaatctaactttcttcccacaacactttctcggcctatccggaatgccccgacgttactcggactaccccgatgcatacaccacatgaaatatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaaaaaaaaaaaaaaaaaaaaaa

SEQ ID NO: 15940 - DNA, 521 bp, Homo sapiens
ggagtgacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacaccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatattcctgctggctaacaacagaatatccaggtcactatggtgaggaaatggacatgatttcctacaa

SEQ ID NO: 15941 - DNA, 573 bp, Homo sapiens
gaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaagaagagattaaaccgaaggtgattaaaagaccttgaaatccatgacgcagggagaattgcgtcatttaaagcctagttaacgcatttactaaacgcagacgaaaatggaaaggattaattgggagtggta

SEQ ID NO: 15942 - DNA, 289 bp, Homo sapiens
taaagaaaatatgttccagaaaggccgagtccccatgccgcatcaggtcagtgatccaagtgcattatagtgaaagtcagaggaaatagctgcttttaggacacgctgaacttgcctaagaaagttattagtgggaataaatgagggggaagaaagcatgctccgactaacgagaacagtatcagcctgacattttgtgtcgtcctaactttgaaaagctatttatacccacttgctagcagtttctatgagaaaaaaaaaaaaaaaaaaaaaaaaaaaaaaaaaaaaa

SEQ ID NO: 15943 - DNA, 332 bp, Homo sapiens
tctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatat

SEQ ID NO: 15944 - DNA, 434 bp, Homo sapiens
caatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttag

SEQ ID NO: 15945 - DNA, 292 bp, Homo sapiens
ataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaa

SEQ ID NO: 15946 - DNA, 252 bp, Homo sapiens
ccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggggagaattgaccatttattgttgtgatgtttaagttataacttattgagcacttttagtagtgataactg

SEQ ID NO: 15947 - DNA, 503 bp, Homo sapiens
cattttgcagttgttgaaattgtccccgcagttttcaatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgccctccccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaaggagaacttcagttgc

SEQ ID NO: 15948 - DNA, 310 bp, Homo sapiens
aaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctggtctgaggaactgaagtagcagacgtgagatccagaccgagggtcacttaattcagctcgcgaatgtgctcctaacttataaagcacttgtaactgaaaaatgcgatgcttcctggtgaataaaacttactgtaagctaggtat

SEQ ID NO: 15949 - DNA, 343 bp, Homo sapiens
atatcaaaataagagagaaccaattcattccttttcagaaaagtaatgtcagggagttcccaagccaccctgtgtggatatggttaaaatggactgaaggatggtggtgatcattgcacaacaatgtaaacatacttaaagccactgagctgtgtgcttaaacattaaaatgataaaaaaaaattgtatatctcaccacaatttaaaaagaaaacagggctgggtgcggtggctcacacctgtaatcccagcactttgggaggcggaggcaggcagatcacctgaggtcgggagttcgaggtcagcctagccaacatgatgaaaccctgtctctactaaaaat

SEQ ID NO: 15950 - DNA, 514 bp, Homo sapiens
gagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatggtctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgtatactctagccaagattgactgtattagatgaaatgtgaggatcttgtcaatcggaacccccgta

SEQ ID NO: 15951 - DNA, 538 bp, Homo sapiens
gtgtcgagacaacctgttgaataggataaaatatttgcaaattattcatctgatagaaactaatatccagaatatgcaaggaactcaaacagttcaacagccaaaaaaaacttaataatcctactaaaatatgggcaaagtacataaatagacatttctctaaagaagacatacaaatggccaacagttatatttttaaaatgctcagtatttctaatcatcagcgaaatgcaaatcaaaaccacaatgagatatcatcttaccccagttagatggactattaataagaattaaaaaaaaacagatgttggtgaggatgcagagaaaaaggagctcttatacactgttgatgggaatgtaaattagtatagccactatgaaaaataacatggagatttctcaaaaatcatactatccagcaatcccattgctgtgtatttatccataagaaaggaaatcatatcaaagggatacctgcactcacatgtttattgcagcactattcacaaaagcaaagatatagaatcaacctgagtgt

SEQ ID NO: 15952 - DNA, 543 bp, Homo sapiens
gtggtggccacttgcgcagaccatacttcgctcgtactcgtgcgcctcgcttcgcttttcctacgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcagggaaggaaagaacttgcatgttggtgaaggaagaagtggggtggaagaagtggggccgggacgacagtgaaatctagaagtaaaaccaaagctggcccaaggtgtcctgcaggctgtaatgcagttaatcagaagtgcc

SEQ ID NO: 15953 - DNA, 454 bp, Homo sapiens
ataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgccctgaaatctgtggagcaaaccacagtttcatacccatcgtcctagaattaattcccctaaaaatctttgaaatagggcccgtatttaccctatagcaccccctctaccccctctagagcc

SEQ ID NO: 15954 - DNA, 362 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgtactgtacattccacaagcattgccttcttattttacttcttttagctgtttaactttgtaagatgcaaagaggttggatcaagtttaaatgactgtgctgcccctttcacatcaaagaactactgaca

SEQ ID NO: 15955 - DNA, 333 bp, Homo sapiens
gcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaag

SEQ ID NO: 15956 - DNA, 352 bp, Homo sapiens
atactaattttttttagaaatgtctacttttataactggggcagggagggtactaggaggacactgtcaataatattccagcctgggctacaagaatgaaactgtttcaggaaaaaaaaagaaagaaagaaaaagaaaatgctcacaaagcaaaaaagccaaaattcaaattcacttgcaccttcaaaaaatcatgttatttcagtggttttttttcctttgaaagaaaataaataatttaaaaatatagtcagtctttgactttggaactgctgaccagtaaacaattcttttagaaaaattagtggttggtagattctcccaatctttcccactttccagtcagtgcttt

SEQ ID NO: 15957 - DNA, 247 bp, Homo sapiens
ctatatgatttagtaaatctacattagtttatttagctaagctttacaaattccctcataatacaacttttttagaggtaactaacagcattgtaaatttttagatgcaaatgtatgccaacaataattcccattgtgtaatactgtgaaattttggtaattaatattttaaaaaataattggagtatttattgactggctagtctgtgttctgttgctttgtgtgaaggaaaaacagaaaaaacaa

SEQ ID NO: 15958 - DNA, 569 bp, Homo sapiens
aacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgcaaacccttctttagcccttcacacatcgcactgaagaatatgatgctgaaggatatggaagacacagatgatgatgatgatgatgatgatgatgatgatgatgaggacaactctctttttccaacaagagagccaagaagccattttttttccatttgactggttccaatgtgtccatttggatgcagtactattcacgagtggacattgctcagattagggttgacctcaagtcccaccaacattcatttgaactcgaagcttgacctcaaacaataaataaggaa

SEQ ID NO: 15959 - DNA, 641 bp, Homo sapiens
ggcgccctaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatgaagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaat

SEQ ID NO: 15960 - DNA, 138 bp, Homo sapiens
caatgaagtaaatctatctgaattatacaagcttttttgctgggacactgtctatatggaaggctctgagagcgcactggcgcagggtttacactgtaccacttgggctggggaaaaaaaaaaaaaaaaaaaaaaaaa

SEQ ID NO: 15961 - DNA, 151 bp, Homo sapiens
ccataaatggtgcctattgatgagtaataaaaatgttatgggcagaaacttgtgttctgtattaatgaaaagtcaagcgtgtctgtgatattctttttaattttagaaggagtgtgtaactttgggcaacagtgacatgtgagaaatgaca

SEQ ID NO: 15962 - DNA, 304 bp, Homo sapiens
ccatgcaggggtcagtgcagcagaggacagtctggagaaggtattagcaaagcaaaggctgagaaggaacagggaacattggagctgactgttcttggtaactgattacctgccaattgctaccgagaaggttggaggtggggaaggctttgtataatcccacccacctcaccaaaacgatgaaggtatgctgtcatggcctttctggaagtttctggtgccatttctgaactgttacaacttgtatttccaaacctggttcatatttatactttgcaatccaaataaagataacccttattcc

SEQ ID NO: 15963 - DNA, 432 bp, Homo sapiens
ctccccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgcatgatgtgtaacgaattctttgaaggcttcccagataagcagcccaggaagaaatgaaaactcctctgatgtggttggggggtctgccagctggggccctccctgtcgccagtggcac

SEQ ID NO: 15964 - DNA, 483 bp, Homo sapiens
attaagattgggtcatgtttcaggttccaacttgaagatgctaccactggctggctaaggatatgaaacctgagtattaacaagaataacttcagtagattgatatgtatcaattatatctaaatccatgaatttctaagactactactactactactacaacaaaaatttgttactgttggaggattctaggaagccaactcactttaacaactgattctgccttttctatataaactgtgctattaggtaatcaaataatagatgagtttgttcttattagaataatattccagctaatgagtgaagaaggaatgttggagttaaaatactaccatttgcaatccctgataagctattgggatctaggcatcaaggctcagtggctgacagataactaaaaagaatacaaccaagcattatgtgcctcctgatagaaaaatcaacactatccaagaagtagtcttgccaaccccatgcctg

SEQ ID NO: 15965 - DNA, 477 bp, Homo sapiens
tacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccgagtgctaacatgccttggttcaagggatggaaagccacccgtaaggatggcaatgccagtggaaccacgctgcttgaggctctggactgcatcctaccaccaactcgtccaactgacaagcccttgcgcctgcctctccaggatgtctacaaaattggtggtattggtactgt

SEQ ID NO: 15966 - DNA, 449 bp, Homo sapiens
atgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgccagaattggcaaatatatagagatagaaagtggattagtggttgcttagggctagcacagagttggggggaatgggaagggctgggggt

SEQ ID NO: 15967 - DNA, 566 bp, Homo sapiens
gaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggatttaagcagatgcaactataaacccaagaaactgtattactattactgttgggtcatactgaacctgtcta

SEQ ID NO: 15968 - DNA, 339 bp, Homo sapiens
ctaaatatcattattaataacactattgcctacagtttcttgtcaagcattcataagtgaatgtgtcttcttctagaaagtcatcttaaggaaataattccaaattgggaaaaggcaatatgcacaactttaattacatcagtttttaaaagaaaaaagagatggaaacactgaaattctaacaaatacccaacaaatattcgagtacattctatgtaccagacactatgctaagcactggttgagaagaccaaaatacatcctcatgatgtattactatgatgcaatgatatttatcaataatatggcaaaaaaaaaaaaaaaaaaaaaaaaaaaaaa

SEQ ID NO: 15969 - DNA, 337 bp, Homo sapiens
aacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatat

SEQ ID NO: 15970 - DNA, 470 bp, Homo sapiens
attagattaagtgacattagggttcttggtaagtttaggaactgtagttttaatggtatgtggcagcagaagccctactgaaatgagttgagaagatagtgtgataaggaaatcaaaacagcaaatggagacaattcttcttaaacgtttgcctgtggaaaaactgaaagcgtttcctcttagatctggaacacaacaaagttgtgcacttttaccactcttatttgttatagtactggaagtcctagctagagcagtcagacaagagaaggaaataaagggcatccaaattagaaaggaagaagccaacttattcttgtttgcagatgatacgatcttatatttggagaaacctaaagactccactaaaaaactgttaggactgataaacaaattcagtaaagttacaggataccaaatcagcatacaaaaatcagtggcatttctgtatgttaacagtgaacaatctg

SEQ ID NO: 15971 - DNA, 560 bp, Homo sapiens
aaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggacatttttcttgaatatatgtactttaaggatattggactgttatggaccggtttaggaaacagatttgcaagggataatgtattataggagtattaggttattcaaatc

SEQ ID NO: 15972 - DNA, 340 bp, Homo sapiens
agagtaaagtttctaaaataacattcctctcacttgtaccccactaaaagtattagtctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgcctcaagataacatttttcattaaagcatctgagatctaagaacacaattattat

SEQ ID NO: 15973 - DNA, 324 bp, Homo sapiens; identical to SEQ ID NO: 9569

SEQ ID NO: 15974 - DNA, 471 bp, Homo sapiens
gggtaacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccataaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactgcacagggagtggtggagagtctatctatggagcgccattcaaagatgaatttcattcacgg

SEQ ID NO: 15975 - DNA, 331 bp, Homo sapiens
ctgatgtgaatataggagagagaaaataacccagaataaggtcacccagaaattatccccatttaatctcaatttctctttcagagaggtcatgactttcatgaaggcgttagagctggtaagtggcaaatgggaacttaccattttggggaaatgggatttgtgagcatatgctgttaattaaagaagatacagattatgcatcccaaatcctaaaatccaaaatgtaccaaaatctgaaactatttgagcaccatcatgacactcaaatgttcattggccataagtataatgcaaatattccaaaatctgaaaaaaaaaaaaaaaaaaa

SEQ ID NO: 15976 - DNA, 464 bp, Homo sapiens
ggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgttcttttaaaaagagattaaa

SEQ ID NO: 15977 - DNA, 352 bp, Homo sapiens
tgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaat

SEQ ID NO: 15978 - DNA, 257 bp, Homo sapiens
gcccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccaaaaaaaaaaaaaaaaaaaaaaaaaaaa

SEQ ID NO: 15979 - DNA, 372 bp, Homo sapiens
tgatgcttttattatgttttctcctgatatttcaaacttttgtttaaagagaattattctctcttcttataaatatgaaatcttcgggccaggcacagtggctcgcgcctgtggtcccagcactttgggaggccgaggcaggtggatcagttgaggtcgggagttcgagaccagcctgaccagcatggtggaaccccatttctactaaagatacaaaagaaaattatccgggagtggtggcacacgcctgtaatcccagctactcgggaggctgaggcagaagaattgcttgagcccaggaggcggaggttacagtgagcagagatcgcgccattgcactccagcctggcaacaagagcgaaactccttctc

SEQ ID NO: 15980 - DNA, 550 bp, Homo sapiens
gaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcat

SEQ ID NO: 15981 - DNA, 380 bp, Homo sapiens
ttcacccgagtctttgaagattcatgaaaaagcaaaaagggccatatcaaagttttgacccaaaggagataaataaatgcggttggatgacgcgaggccctctataaaacaaaggacaaccattgggctaagagaaaaaaagatgttgggggggaagagccaaggggatttgttccttatattggaattgtgacgatcctcatgaatgactatcctaaatttaagtatgcagttctctttttgctgggtttattcgtgctggttcatcgtgaagtaagaagcctgccttgctgttcctgggaagatgccatagttttcgttactggatgtttggagtaagatactggtctgtgattgggtggaatggagaacacaccgtg

SEQ ID NO: 15982 - DNA, 489 bp, Homo sapiens
cactgggctgacgtcaagcagtatatctcaggatgatttaggacctcctcaatgtaagtctatcacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgcactttgatggttctctcttgaattggctgccagaattgaaccaacccaacccctagctcacctcctactgtaaagagaatgcactggtcctgacaatttttatgctgtgtcagccggtcttcaaaactgtaggggggaaataacacttaaggttctttttctcatctagaaatgctttccttactgacacctaacatc

SEQ ID NO: 15983 - DNA, 340 bp, Homo sapiens
accctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcgcggggaagagctccctgctgtgtgcctgcaccaccccactgccttccttcagcacctttagctgcatttgtatgccagtgcttaacacattgccttattcatactagcatgctcatgaccaacacatat

SEQ ID NO: 15984 - DNA, 520 bp, Homo sapiens
tagtgcatcctaaagaaatgccctgcttctgtttgcgccatgatgttggatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgcgagtattcatctatcgcagcctgctcccatgtccactgtactttacaacagaaaggaaggcaggcaagtaggacaggttgctaagcagcaagtagcaagcctagaaaccaatgatcctattttaggatttcaggcaacaaatgagagattatttggtcttactaccaaaaacctctttttaataaaagtaaatcagagaattaattattctaacatattggcctctttgtactggaaaagtatcagggggacctggagggctggcaggtatctggacctctaagtttaatgggctaaaatatctggatga

SEQ ID NO: 15985 - DNA, 312 bp, Homo sapiens
gaaggaaaaagaaaagaaaaagtagtcgcagcctggagaataaatttgacctctttagttttatattgttgcagctaaaacctgtgatgaggtcattcttagtgaactacttataactacttagttcttataaatgctgccaatgttttctttaatcgtgatatttaagaaagaaaaaaattaagataaatagtcaatacatattgatgagttatatgaatttgtttattcttggtattgcttcttagttgtaaaatgtgaaatggttccaaagaatgggcttttagttctgttttttgaagtagcagctat

SEQ ID NO: 15986 - DNA, 361 bp, Homo sapiens
aactttaaaacattcctgaatggcatcaaagtggactcgaacaaatggaaagacattccttgttttaggtagagtgactcagaatggtaaagatgtcagttctcttaatatataagtttgatggaatcccaataaaaattctagtaggtcctctagactcctagatctagattgatctattcatgtggaaaaaataaacatggaataatagttatgaaaaccctggtgaaagtagtgatgagaaggatgagccaccacacccagccaggtctgcctatttttttttttgagacggagtcttgctctgtcaagactcccacatattgaaccataccacaaggtatctctaattaaaactgta

SEQ ID NO: 15987 - DNA, 254 bp, Homo sapiens
attggggacagctccccacacctccctgagggaccagcgactgcagctgagtcatgatctgctcggaatcctgctgctaaagaaggctctgggcgtgagcctcagccgccccgcaccccaaatccaggaggctgctggtacaaatactgcagaaatgacaccaataatggggcagacacaacagcgtggcttagattgtgcccacccagggaaggtgctgaatgggaccctgttgatggccccatctggatgta

SEQ ID NO: 15988 - DNA, 419 bp, Homo sapiens
gatggtgaaaccccatctttactaaaaatacaaaaattagcctggcatgatggtgggcgcctgtaatcccagctactcaggaggctgaggcagaggatcgcttgaacccgggaggcggaggttgcagtgagccgagatcgcgccactgcattccagcctgggcgacagagcgagactctgtctcgaaaaaaaaatacataaacatatttatatatttgactgatgttactgatataatgattttatccctcaatttggaccccattcagtttacatttcagagattctcctaatgaactcaaaagggttcatcagatgtgaccatgatataagaaggtggcttctgttttgttttcttgagacggggtgttgctttgttgcccaggctagagtgtagtagctatacctgcagatgcttt

SEQ ID NO: 15989 - DNA, 604 bp, Homo sapiens
  misc_feature 565, 581, 582, 583, 584, 585, 586, 587, 588, 589, 590, 591,592, 601: n = A,T,C or G
ccatgcaaacattaatattggttttatgactgtgcacaatgcagtaacacattgctgagctgccaagaaatttaaagaataaaaaagatttagacactgaaagaaccttgaatcattgaatttggggaggtagggaggaaggttggagtatgcctaggagctgattatgtggcttccaacaagtgaactagagccaaactatgtgtattttaaatgatttggatccttaggtttagtactggtgggtgtggctcagttctgcctagtcaccattcagtggtgggtcaggaagccaatgggttcagcaaaaaaaaaccggaatgacagtctgtcagcatggaggtgaccactgaacctgtggaaggtaaggaaactactagaggaaggcagtgccagcacttgggacacatgctatctcttcccttttttgtacccatagtagacatcactaatcaatggcggcacctttgccctttgagtccagatataaccttgggatcctactaacaaaggggcctatgcacagttgccataattgatacaatttgccatataaactgaaatnaacattcccaaaaaannnnnnnnnnnnaaaaaaaancgg

SEQ ID NO: 15990 - DNA, 146 bp, Homo sapiens
agaagtaagggctcctagacaaaatattctgttctccattttgtggaatggattgtttcagtccatttccaacaggttcgcattctgttttcatgttaggttttctgaccttcagtggttttgctatcatgtcttgagcatatggt

SEQ ID NO: 15991 - DNA, 374 bp, Homo sapiens
ttttctctttgaaagatagagattaatacaactacttaaaaaatatagtcaataggttactaagatattgcttagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaaggtgacttaaacagcttaaagtttagtttaaaagttgtaggtgattaaaataatttgaaggcgatctttt

SEQ ID NO: 15992 - DNA, 412 bp, Homo sapiens
atttacctagcactataaaccctgggtgcctctgaagaaactgccttcattgtatatatgtgactattcacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgtcaaaaccccagccaatgaccagcagttggtatgaagaacctttgacattttg

SEQ ID NO: 15993 - DNA, 332 bp, Homo sapiens
gaagttcgatgaaagtgagaaaactaaggagagtcgtgaagcagttgagaaagaatttgagcctctgctgaattggaggaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatg

SEQ ID NO: 15994 - DNA, 487 bp, Homo sapiens
caaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagaa

SEQ ID NO: 15995 - DNA, 436 bp, Homo sapiens
ggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggta

SEQ ID NO: 15996 - DNA, 551 bp, Homo sapiens
ggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggccaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggattttctgactggaatctcacactgaaaaaaagcacacccttttaagactac

SEQ ID NO: 15997 - DNA, 483 bp, Homo sapiens
gaaggaaaaactgaaaatggaagttaagcagcttcgcaaagaagtgaagttgcagagacaactagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtcaattatggaaataagaacattacttgagcatgacacttctttcagtatattgcttgatgctcaaataaaggtttgtcttgg

SEQ ID NO: 15998 - DNA, 210 bp, Homo sapiens
cccaaaatgacctggtggcactcatgaagacactacccccctttggaaggcacccagacccaggccttctgaaatttctcagattctctttcctcaaaggcacaacttcaagacaggaatcattatggcagacaggaagtcagtgtcaagattgaagggctcactcccaagtaatctcagtaaagccgcatttagacccaactcctcgaa

SEQ ID NO: 15999 - DNA, 510 bp, Homo sapiens
ggcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccatggcttgggtttattgg

SEQ ID NO: 16000 - DNA, 177 bp, Homo sapiens
agagagaaagtccagtggggagtgggtgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctg

SEQ ID NO: 16001 - DNA, 334 bp, Homo sapiens
tataaagccactgcaaatatagaactggcacatacggaaccactattcttacaggaaatataaagttaggatcctgagagtgctagcaacaacatttttttaaaaaaattggttgatatataaccttgttttatgtttcaacaccttatttaaaagatattgtattttcattaacactgaacacacagccaatagcagtataactcatgcctgaatgaagcatatctaacatacatattttccataaggcacaccacagccttcatgtgcttaggatcattagacaagcacttcagcactatactttggggcaattttaaatagcaaaatcccc

SEQ ID NO: 16002 - DNA, 504 bp, Homo sapiens
ggaagatgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcggtgtggtggtgtttctctttgtgtattttttgccatgacttgttcgctgatatctaaattaagaagttggttctcgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagtcttaaaattaaacccttggttcgtgtttaaaaactttcaaacatctgatggctttacagggctgaatataaaagcatttgtacca

SEQ ID NO: 16003 - DNA, 344 bp, Homo sapiens
ggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgcaccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcag

SEQ ID NO: 16004 - DNA, 288 bp, Homo sapiens
ccgcggagcccgggcagaggttttaggggaaggattaacaaaggcgtccgaagaaatcgttgttggaaggtgaccaaggtggaaagggacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgct

SEQ ID NO: 16005 - DNA, 552 bp, Homo sapiens
attccttatttttgttctcaaagaaaaaaaaaatccccacatcttcattgttttgtcattttccaaaagactgttcttttcctgatactgtatcaggtactaaaagttacctggattcagtccattgaaagatgagtgatagtccacaagagagggagaaataggatgaaacatcttaattttaaatttattctttacttttaatttagtcaaaacctattaaatttttcatgtattatatctgctgtggtagagaaagaactggaatttagaagtaaggcagatctacatttaattctagaccttatgttcaaatacagttttaccttggggaaagcagttaagctccctgagtcccagtttttctgtctgtaaataactatgataccacctatgtcactgggatgtttttaggattatagaaagtaagaatgaaagaatgcctagtatgtaactgaggcattgtagatggtcatttctgctaccttcctttcttccttatatataattcattcaacaaacattagatataatttctggtttgaggggctg

SEQ ID NO: 16006 - DNA, 321 bp, Homo sapiens
gacaatgagtaatgattacagttaattaagttaggcaacctccatttccattcacttagtagcactgctaattatactcatgctacaaggtttctttagttcttctgtaatttggatgcagtactctttgtagacaagggaatacggtacgattaatgagatttttcccaccaacacctcctgttctctccaaatgaaatttccgcatctgaaaattgagagtagggaacggagaaaaaaaaaaatcagtcacattttaacttactgccagcacggtccatgcttataattgccaaatattttatattaaagaaaacaagg

SEQ ID NO: 16007 - DNA, 333 bp, Homo sapiens
gtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgctcaaag

SEQ ID NO: 16008 - DNA, 421 bp, Homo sapiens
atctgatctcaatccggaccattgagtcagaaacacaaagcttgaaacctcgagagggaagactcctgacatttctagtcatgccagcttcccatcaagccagccacattcgatgaagtgtcctcaggcattttggcacgtccagttctgttcccggtccaggttgtggtttctttgaaagcagcaggtgtaggtggtaggtgcatggaaagaggccactgaacttcaaggagtttatgtcagggatcggctgcagggctgaggagagagggttgcagcattcaccttcctcagctcgtttgctatgtcctcctggaggagagagaaattcagcaggaataactggatttcatcgggtaaattccacaaatattgattaagtattccccaccccaccctgttctggtgagtctcagtgtgg

SEQ ID NO: 16009 - DNA, 317 bp, Homo sapiens
caggaggaaagtaaggacctcaggaagtgtatagtgagaaagaggtagagtatctttggattttattgacattgacgtaagtaggctaaaataagaattggtacacaggaggggacgcttaaaatggctatttaggggtagtgcagcaaattgtgatgaggtcaagggtatgaactgagttggtgactgaggtggggaagggtaatattggaagcaaagatattgagaaagttataatccagtgggtctggtcttggatgttgaaacaaccaaggatttagttggcaaaaaaaaaaaaaaaaaaaaaaaaaaaaaaa

SEQ ID NO: 16010 - DNA, 482 bp, Homo sapiens
tatttgaaatggaaagacatttattaaaactgattttttaaaatagcgtgaacctttgtccttaaagtaaattaaaagaccaacagacaaaaagtaaaagtctttcatctccaatcacctcccctcaagaggtgaccactgttaacagtttcttatctttatttatgtagcttttctaggcataaacttacaaatacgtatcttttgttatgggttaattttttttcttttttagtataaataggagtacactataatactgttctgcagttggtccttttaagggtgattcttagtcaactctctattaatatgtatagaattagaatggaaaacttttgaaatatcaagcagtttgccatcatacagatatacttggagtttgtggttgttttattcattagataagtctttagattttaagaaattcagcaagcaaattcccttcacaaataatttgactataaggattatattaaaaa

SEQ ID NO: 16011 - DNA, 235 bp, Homo sapiens
caataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaa

SEQ ID NO: 16012 - DNA, 357 bp, Homo sapiens
tactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaac

SEQ ID NO: 16013 - DNA, 339 bp, Homo sapiens
tgactacttgcatttaaaacagacactgtcatggatatagatttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 16014 - DNA, 335 bp, Homo sapiens
agcgagttttaacatagtggtaattttgcaaatgccaacatgaatactagtgagtactcaatttacgacagacaatttcacaaaaaccaaccacagagtgatttgatattcttgcttcttagagagttttctaatccatataatgcaatgggtcaggttgctcatatgattaaaaaaattaatcctgtagaaatgatgtattagacatctctaacccaagaaaaagatgtcttttgtataacttttaaattcccatttgtctatcttaggacaaatgatgacttcttcgtgtagtaatgaaaacgctaaatcctgctctgtggagaaaagctaga

SEQ ID NO: 16015 - DNA, 338 bp, Homo sapiens
gttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattc

SEQ ID NO: 16016 - DNA, 202 bp, Homo sapiens
atagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaaaaaaaaaaaaaaaaaaaaaaaaa

SEQ ID NO: 16017 - DNA, 534 bp, Homo sapiens
atagaagacagtttgcaagagaagtggtgtacaggaaattacttcatttgacaggagtatgtacagaaaattcaagttttgtttgaggcttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgggaaacacaggccatcagggaaaacgaaatgctgcactattaaattagaggtttttggaaaaatccaactctcatcctggcagaggttgcctag

SEQ ID NO: 16018 - DNA, 535 bp, Homo sapiens
ataatgaaatagataactaaaagtcaaatttaaagaaatagaaatttgttagtgcatttatgttaatttttaataggaatagcatcttttaagaatccaggtagaaaaaatatatgttcataaaggtaaaaatttcagctgacatcatacttttggcattttctttcagaaaatggtgatgtaattacactcataactctttgggtataaagacaaaacacaaaaatgctaggtgaattgaatgcccacatgtaactgagaacatggaaaaaaggaactctatatccttttctactaactctgttctttgattcaccctgcaacttggcatatatatctccttaaatcctacttaatctccagataaagacagcaacaacatcataattccacacaacatgatacaactattgccatacaaccaaatgttcactgatcccttcctcctaaagggaagaaaatttcgtttgtaataatttttataaagtactctactcaattcccttcaaagtaaaaattgctcagagaactattt

SEQ ID NO: 16019 - DNA, 217 bp, Homo sapiens
aaatttagattgctcgaagctggcccgagccgactggataccgcagctaggaataatggaataggaccgcggttctattttgttggatttcggaactgaggccatgattaagagggacggccgggggcattccgtattgcgccgctagaggtgaaattcttggaccggcgcaagacggaccagagcgaaagcatttgccaagaatgttttcattaat

SEQ ID NO: 16020 - DNA, 443 bp, Homo sapiens
ctttgattgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttgcctagcatggcaaatcacc

SEQ ID NO: 16021 - DNA, 337 bp, Homo sapiens
ctcaaccgtgctgtacaaatgtgtggatttgtaatcaggctattttgttgttgttgttgttgttcagagccattaatataatatttaaagttgagttcactggataagtttttcatcttgcccaaccatttctaactgccaaattgaattcaagaaaccgatgtgggttttgtttcctgtacaattatgagatataattctttttcccattgtaggtcttttacaaaacaagaaaataatttatttttttgttggtggataaagaagtcaagtatctgatactttttatttacaaggtgtgatggttttgtatagtaggttccaccctgagtattcc

SEQ ID NO: 16022 - DNA, 525 bp, Homo sapiens
gagcagagggagatacagaaaccgacaggggccaggcacccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgtggtcatgctgggaattccctctgca

SEQ ID NO: 16023 - DNA, 342 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaat

SEQ ID NO: 16024 - DNA, 413 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgcaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaag

SEQ ID NO: 16025 - DNA, 475 bp, Homo sapiens
ataccctaaagatgatttcaaattatatcctttgtataaattttgaatactagtagggcaatcagaaacatttgaaatttgatattttaaaagtattttgattggaaaggagcttaaaggcagcagcacactattttattctgagtattacctgtggacaagaagattaattctgctaagagcatgctttcaaaactggaaaacccttcaggacaagtcacattttgtgacagtgagacgccaacaaccctgagaggtagtacagaaagaaaaagatggaggcagggtttgggaagttctggtgttgagaagtttattttcatttctcatggttccagggagggcagcaagttgtagaatacctcattggtgagctctgagggttgagggctttatattctcgggcatcacaaaatttatagcatggcagagaatttagaccaggacctcaggaatttggtgagactggcggtgc

SEQ ID NO: 16026 - DNA, 306 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaag

SEQ ID NO: 16027 - DNA, 357 bp, Homo sapiens
taagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtag

SEQ ID NO: 16028 - DNA, 316 bp, Homo sapiens
atattcagagtggtcaacataaatacacatgtagacaagagatagtatatgtgtgtgtgtatacactgaggttacttcttgaagaaataggcattttttcctttctttttgctttttctttcttttctttttctgagtaaaggaccccagagattgtctttcactttgaaaacaatctctaataccaggaaaatgcgctgtttgtttatgcgtacataatgcaagtttgtccgcctgggaactgcagcaaatgggagaagtatgcatggatttcacaggtaacaggattacgtgggcacataattgatccatttgg

SEQ ID NO: 16029 - DNA, 413 bp, Homo sapiens
attcaaaagctagcagaaggcaagaaataactaagatcagagcagaactgatggagatagagacacgaaaaaacccttcaaaaaaatcaatgaatccaggagctggtttttttgaaaagatcaataaaattaatagaccgctagcaagactaataaagaagaaaagagagaagaatcaaatagactcaataaaaaatgataaaggggatataactactgatcccacagaaatacaaactaccataagaaaacactataaacacctctacacaaataaactagaaaatctagaagaaatggataaattcctggacacatacaccctcccaagactaaaccaggaagaagctgaatccctgaattgccaataacaggctctgaaattgaggcaataattaatagcctaccaactt

SEQ ID NO: 16030 - DNA, 160 bp, Homo sapiens
gcattatgctgcatgagtggagagtactctggtccgagcctcccagatgaaactatagactttaggatttaaaaattagagtttcaacaaagtcacatttaatgagtatgtatacatctatatataatctagagaccagttacaactgtttctttacaat

SEQ ID NO: 16031 - DNA, 202 bp, Homo sapiens
ttaaaaatcatcattgcttaaatctctgtagggtgttggaactggttgggaagaaaggaacagaaagaacagaacttggaaacaaattctgcccatagtgttcttggtcacttttgcagatcagaattagtagctggttctccagcaaatctgccacctcctgtgttgcccttaggtgcctaaaatattatagattttcaat

SEQ ID NO: 16032 - DNA, 444 bp, Homo sapiens
cctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctacccgtccctcaagcacaccctggtga

SEQ ID NO: 16033 - DNA, 360 bp, Homo sapiens
gaaaagcagcagctgtagtgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgt

SEQ ID NO: 16034 - DNA, 246 bp, Homo sapiens
tgaggccaggagttcgagaccagcctggccagcatggtgaaaccccttctctactaaaaatataaaaattggctgggtgtggtggtgcgtgcctgtagtcccagctactcaggaggctgagacaggagaatcacttgagcccagcagtagaggttgtagtgagccgagattgcgccactgcactccatcctgggcaacagagcgagactgtgtctcagaaaaaaaaaaaaaaaaaaaaaaaaaaaa

SEQ ID NO: 16035 - DNA, 359 bp, Homo sapiens
atagccctactattcgatatgagatgaggaaacgttcttttataaaaaattactcagtttttatttatatagagatgagaaagataaacatggaagtaaaaagaaaataaattttgaaatacccaacttattaaaatatgatagaattttgttgaagaatataaaatcaagacctgaagaaatggaggtgcgtgatacgttcctagaaacataaagttaatgtcattattaacatgtcagaccaggtgcagtggctcatgtgcgtaatcccagcactatgggaggccaaggcaagtgattgcttgagtccagcagttggagaccagcctgagcaacatggcgaaaccccatctctacaa

SEQ ID NO: 16036 - DNA, 470 bp, Homo sapiens
ttaaggaagaagggagatagatgatagctagaggaagagttggagttgatttgtttattgtttggttgtttggttttgggggcaagaaggaatgagagaggttcttcccattaataactgaggaaaagtaactaggtttgaacctgagactttagcctccataatggaaaaacttctttagaactctccgggccttctaatcctggtttactattaactctgcaggacacagtgttcaagttatcttccataccatttcctatggaaagaaagaatatttctggccaggcgcggtggttcacacctgtaatcccagcactttgggaggccgaggcagggcggatcacttaggtcaggagttcgagaccagcctgccaacatggtgaaaccccatctctactaaaaatacaaaaattagccggcatggtgcccgcacttgtaatcacagctctcggagctgagggaggaga

SEQ ID NO: 16037 - DNA, 223 bp, Homo sapiens
taacgtgtaagaatctacttttattttggattcatggattcatatattgttattatttaaaattgatccatgatgaaaggattaaactaacatataattcgacaaatatgaagatggagaggaggacttcaaccatgtgatgattcaagatatacgatcaacataaaatgaaacactagctcccaacatggtgaaaccctgtctctatcaaaaatacaaaaaa

SEQ ID NO: 16038 - DNA, 204 bp, Homo sapiens
ggcagaaaagattatatggcatacctccattggggaataagcataaccctgagattcttactactgatgagaacattatctgcatatgccaaaaaattttaagcaaatgaaagctaccaattgaaagttacggaatctaccattttaaagttaattgcttgccaagctataaccacaaaaataatgaattgatgagaaatacaa

SEQ ID NO: 16039 - DNA, 339 bp, Homo sapiens
aaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttcccgagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagc

SEQ ID NO: 16040 - DNA, 411 bp, Homo sapiens
agcaaaggaggagtcaactaatgaagaaatgaataataaattttgacactgaaaaacattttattaataaagaatattgacatgagtataccagtttatatataaaaatgtttttaaacttggcaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctcttttgt

SEQ ID NO: 16041 - DNA, 400 bp, Homo sapiens
ctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcatacccaattggaccaatctatcaccctatagaagaactaatgttagtataagtaacatgaaaacattctcctccgcataagcctgcgtcagattaaaacactgaactgacaattaacagcccaatatctacaatcaac

SEQ ID NO: 16042 - DNA, 546 bp, Homo sapiens
gctgagggggcaggcggcagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaccgcgacgaaaatggaaagattaattgggagtgt

SEQ ID NO: 16043 - DNA, 154 bp, Homo sapiens
ctaaaaaatcccaaacatataactgaactcctcacacccaattggaccaatctatcaccctatagaagaactaatgttagtataagtaacatgaaaacattctcctctgcataagcctgcgtctgaaaaaaaaaaaaaaaaaaaaaaaaaaaaa

SEQ ID NO: 16044 - DNA, 486 bp, Homo sapiens
atgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgttacatttactaagtgtgctgggtcatgtaaaatatagacactaatatttcatagaaatag

SEQ ID NO: 16045 - DNA, 472 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaatttttatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaag

SEQ ID NO: 16046 - DNA, 128 bp, Homo sapiens
gagatgtatgaaggcttttggtctccctgggagtgggtggaggcagccagggcttacctgtacactgacttgagaccagttgaataaaagtgcacaccttaaaaaaaaaaaaaaaaaaaaaaaaaaaa

SEQ ID NO: 16047 - DNA, 191 bp, Homo sapiens
agaaaaaaaaatttgattaaaaatggataaaagatctgaatggacatttctcaaaagaagacagacaaatggccagaaggtacatgaaaaaatgcgcaacatcactaattatcagagaaatgcaaaacaaaaccacaatgtaaaatccacttgccctagttaaaatggcttgtattaaaaaaaaaaaaaaa

SEQ ID NO: 16048 - DNA, 300 bp, Homo sapiens
cctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataa

SEQ ID NO: 16049 - DNA, 285 bp, Homo sapiens
  misc_feature 273: n = A,T,C or G
aagggtgctcacatttcccttgttctgatcagtgcaatagtactttatgtttactctgtcaggaaagcgtcagatgcttttatttccaattataagttttgtaatgcatcatgtattttgctgacagtcttcaagttcttgaaataagtgaacaaattaacagcagatattgagtgagaggattagaaaaccaactggcaactcatatgatagaattcagatcagggatgggcggaatggctcatttattttattttctcagtcatactttgnaattaacttagg

SEQ ID NO: 16050 - DNA, 426 bp, Homo sapiens
ttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatacccatcgtcctagaattaattcccctaaaaatctttgaaatagggcccgtatttaccctatagcaccccctctaccccctctagagcc

SEQ ID NO: 16051 - DNA, 342 bp, Homo sapiens
aatgagcgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggttttgaactgcaa

SEQ ID NO: 16052 - DNA, 403 bp, Homo sapiens
tgcagaagtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatc

SEQ ID NO: 16053 - DNA, 396 bp, Homo sapiens
gattagttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaaattaggttcagggggtacatgtgcaggtaaactcgtgacaagggggtttgttatacagattatttagtgacccaggcactaagcctagtacccaatagttacttttctggtcctgtcccttttcccaccctccaccctcaggtaggccccagtatgttattccttt

SEQ ID NO: 16054 - DNA, 515 bp, Homo sapiens
ttgaggaagacgcggtcgtaaggactgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcaggatgcttaaagtcaactattttaataaaatggatgaccagttgc

SEQ ID NO: 16055 - DNA, 321 bp, Homo sapiens
atatggatcagaggcataagtgcagaggctgtggtcatgtggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagc

SEQ ID NO: 16056 - DNA, 342 bp, Homo sapiens
taagagaaagacacaagggtattcaaataggaagagaagaagtcacattatctctgtttgcagatgacatgattgtatatttagaaaaccctattgtgtcagccaaaaagccccttaagctgttaggcaatttcagcaaagcctcggtataccacatcaatgtgaaaaaatcacaaacattcctatacaccaataaaagacagagagccaaatcatgagcaaactcccattcagaattgctacaaagataacaaaatacgtagaaatacaacttacaagggatgtgaaggtccccttcaaggagaactacaaaccactgctcaaggacataagagaggcact

SEQ ID NO: 16057 - DNA, 259 bp, Homo sapiens
aaactgggctgaaagtttctttgtccaaacccagcctcttcttcctgtgatgtcatattacaaatctaggaagcctttctttttcacttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaaaaaaaaaaaaaaaaaaaaaaa

SEQ ID NO: 16058 - DNA, 228 bp, Homo sapiens
aacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagt

SEQ ID NO: 16059 - DNA, 276 bp, Homo sapiens
caaataaataaataaataaataaataaaatgaaaaattcaccagatggatttagctgcagataacatactgtggaagaaaggatcagtgaatttgaggatagatcaatgtaaaccatccaaatcaaagcacagagaaaaaatagacaaaaggaaaatgaacaaagctataatatcttcaaggatattatgcagcttaacaattatgtggtttacaggtacagaaggagagaggacagagagattggggtagaaaaatatcaggagaaatggtgacc

SEQ ID NO: 16060 - DNA, 285 bp, Homo sapiens
aatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaagg

SEQ ID NO: 16061 - DNA, 164 bp, Homo sapiens
cattgaaaaggatcataacagaggacttcccaaacctagagacagatatcaatatttaagtacaagaaagttatagaacaccaagcagatctaacccaatcagactacctcaagacatttaataatcaaactcccaaaaaaaaaaaaaaaaaaaaaaaaaaaaa

SEQ ID NO: 16062 - DNA, 606 bp, Homo sapiens
gattttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtccacccttaccaaaggaatcagcctatctttacgcacgattcaacaaaattaaaaagctgctgccaaagattttgcagacatcctaacttaagaagactcgattttacaggaaatttgatagaaagatatagaagatggtcctttttcaaactttctctggtagaagaacttcacttgct

SEQ ID NO: 16063 - DNA, 396 bp, Homo sapiens
gtctatttgtagaagaccagattctcttttatctcagactggatgaagttgtataggtagagatattaagtgctgaagtatgtatgacaaaaatatgccagtccttgtttttattcccttttagcctgttggattctgagaataggtttgtattgatagacttatattggcctacttggatgtttaggatagtgtgttgctctggcggcatttgaaacaaggaagagaaagatgtaatggggtccttatccctaataaaatttgttatggtacttagaatcattcaattgtatgattcttctcaaaggtgagaaacattttacaggtaattcagccctttattttaaaaaggaggaaaacaaggtttagaggaaagtggttgtggtgggtagtagc

SEQ ID NO: 16064 - DNA, 317 bp, Homo sapiens
  misc_feature 309, 311: n = A,T,C or G
gccagtgtggaagaactaaaggaaattgatgcggaagcgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgngnagattg

SEQ ID NO: 16065 - DNA, 369 bp, Homo sapiens
ttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgggtttgagctattaaagtacttcttacacattgg

SEQ ID NO: 16066 - DNA, 331 bp, Homo sapiens
cacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcgcaagtttcctgggctggaccgtttcaacagagaggcttatttgactttatgctagaagatgaggcttctgggataggcccagaagttcctgatgaccgcgacttcgagccctccctaggcccagtgtgccccttccgctgtca

SEQ ID NO: 16067 - DNA, 252 bp, Homo sapiens
gagacgcctctgctaacgggaatgctaatgaggaaaatggggagcaggaggcttgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcttat

SEQ ID NO: 16068 - DNA, 471 bp, Homo sapiens
tagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgtcactgttcctctgtcatactgtatctggaatgctttgtaatacttgcatgcttcttagaccagaacatgtaggtccccttgtgtctcaatactttttttttc

SEQ ID NO: 16069 - DNA, 234 bp, Homo sapiens
ggctatatataaagaggaacagatagcaagttcttccacattgtattactgtaattttaatcttatttgtagttgtgggatttagaaatacttgattcagaagtatgtctttaagttaattgattataattttgactcttaagggcattatgaaaaagtctttttctgattcttaacaaaattctttcaagttagctagtttcaaaaaaaaaaaaaaaaaaaaaaaaaaaaaaa

SEQ ID NO: 16070 - DNA, 476 bp, Homo sapiens
agtataatctaagtactgatgtgaaaggactttgcagatgtaaattaaggtcacaaatcacttgcaattagtcaagatgatccgggttggcctgatctaatcacatgacaagtcagagacacaggaagtcagagaaatttaaaacatgagggatttgacatgaggggctctgtctgttgttggcttggagatggttggggccatgtgacaaggaatgggagcggcttctaggagctgagagagacccttgggtgacagccagccaggaaatgaagaacttaatcctacaacaggaaggaactgaattctaccaattttgataagaatcttccaaatacttccctggagccggagaagtcagccaggttgcactttgatttcagcctctgaaccctgactgagaatccaggtagactttgcctggcttctgatctagagaactgtgaactaatggcattatttaagccactgtgatt

SEQ ID NO: 16071 - DNA, 187 bp, Homo sapiens
acgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaaaaaaa

SEQ ID NO: 16072 - DNA, 468 bp, Homo sapiens
tcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaacagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaatttgctgtgtggtcacacaaggtctacatacaaaagacagaattcagggatggaaa

SEQ ID NO: 16073 - DNA, 346 bp, Homo sapiens
aaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagaggtgcaccaaaaagttagggaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaat

SEQ ID NO: 16074 - DNA, 384 bp, Homo sapiens
ataaaaaaatattactgaataaaaatctaattaaaacatttctggatgtttgttgatgaaagcctcctttaatagggtttcattttctcggtattcttatgagagctattaccagttcttttgactcttttctatttatatcacgaatacatcccagaatcaaatatattgatcttaacctcaaagaggaatctgtatccagatgttttccactacactcaacatgtagactagtttttattacataaagttttatggccgggcccggtggctcacgcctgtaattccagcactttgggaggccaaggtgggtggatcacctgaggtcaggagttccaggagttcgagaccagcctggccaacatgatgaaactccttctctct

SEQ ID NO: 16075 - DNA, 516 bp, Homo sapiens
caatgagtaattgaccaaagtcacaaattaaaggttttcattgttgtgtttattaacaaggttttaggaatgtagtggtttatagaagataaaccaaatacttagtatttgaaatttctatcagaatcaaagttctagaattatacagtgtatagtttcttcagcgatgttcctaactttgttttaattttaaactccattggtaataggtatttagctgtaatttaaatgtaattgatacattcatattttcattaattctcagctttaccacctatatatcaccaaaataacttcatgtccttttgatctgagcattacaaatcttagttttgtctttggaattcagaattttctgtgagtaacagcttttaaatgttataatattagattgaaccgtatggaaacaatctttttttggttcagtctaatatgtcattattagagatgactggttgaaatagtcttagcatatcacacaatataattttaaaaaacactgatattttaacagac

SEQ ID NO: 16076 - DNA, 414 bp, Homo sapiens
ataggtgtctgttcccagttgatacccatgaccctcaccacctccagaggtccccactgttctcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacgggggtatatttctgtttagctttagtaaattctgccaggttacactcctaccagcaatgtatgagagtttagtgtcaccattcataacactgtagcagcccttttcggtt

SEQ ID NO: 16077 - DNA, 263 bp, Homo sapiens
gtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16078 - DNA, 302 bp, Homo sapiens
tgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaat

SEQ ID NO: 16079 - DNA, 456 bp, Homo sapiens
gcgatgtactgtgctctgcatgtattttgactacctgaagatcttatcagagacaccagaactttaccatgaaagtggcttggcaacatttctccgtttgtaatgctttaacaggtgtagaagaatcagtgagacaaataaaacaatcaatacttaatgaagtctggcagaaattttggaatgaggttgtgactgatttggaaggtttccttccagtggtagaagaaattgaaaatattgtaacatctgcaaaccatttgaatagtgaaggccttgaagacattgagttaagtgacattactgaattgttagactctcaccttcaaaagatagttgagaaatattttggagatgtgatcacatcaaaaggcaatagaagaagccagcataggttaacatccagaactctaagaatgttcaagtatctactccacaaatgaaattgcacaatgattc

SEQ ID NO: 16080 - DNA, 361 bp, Homo sapiens
gttaccatgtgagaggtttcattccattactacaagctgaagagcttcggataagactgatttagttgtcctccaaaacaataaaaatgttcaatttcttctgtgtaatcattatatatatatgcctcaagatatattctattaatggaataatcaacatacatttatagataatatatttattttagcacatgcatcatcttgcatggaaaaactcttgtcctcagaggtatataacagtgggtttttttctcccttatcaataagaagcctagctaactctcatgaccacccttagtgcatataaataatatataaccacaatattgtcctttaatgttaagagcttagtaaatagtgc

SEQ ID NO: 16081 - DNA, 578 bp, Homo sapiens
  misc_feature 549: n = A,T,C or G
tcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgccgtccagaaaaggctatgaaaagactgtcattgaaatcaatacaccaaaaaattgatcaagtacctattgttgatgtcatgatcaatgactttggtgatcagaatcagaagtcggatttgaagttggcctgtttgttttcttggctaagattacgacaaagaacatatcatatcaacagatacatccttggtgccaccacccattttgtgcccatgcaagttttgaataaaggatggtatagaaacaacgctgcatatncaggtccatttaggaaataccgatgcctt

SEQ ID NO: 16082 - DNA, 392 bp, Homo sapiens
gtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaaggtaagaaagcttaaaaggaaacctgaatgtattaatttcaaaggaacaatactatgtcgaattacagattcaatttggatgaaatagaagagaaaatgtatctggctaagagcagaacagtatactgtttgtggtttagtttgtgcctataaatatgctggagtgccttgtataacatccttggccagtagcttgtttaccccattcattaaacatgacaactatatttccagtc

SEQ ID NO: 16083 - DNA, 339 bp, Homo sapiens
aaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggcctcgcaaaatgatcaagcctttctttcattccctctctgaaaagtattccaacgtgatattccttgaagtagatgtggatgactgtcaggatgttgcttcagagtgtgaaggcaaatgcatgccaacattccagtttttt

SEQ ID NO: 16084 - DNA, 453 bp, Homo sapiens
atagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacc

SEQ ID NO: 16085 - DNA, 517 bp, Homo sapiens
agaatgagcgagcctaccaaaagcagccgaccatctttcaaaacaagatgagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 16086 - DNA, 349 bp, Homo sapiens
atggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctac

SEQ ID NO: 16087 - DNA, 281 bp, Homo sapiens
aatgttatttatagaacaacattaatccattaaagctaacctatttttcaatatttatgataatctatgtacatatattgtcggtccatatgtatttgtaaataggttgtatataatgtcaggtttgggtcttgggttcgagtgtatatattcctgtaagtttcttaactgcattttgatgaattcacattatgtaactataagaattgtcccaaaagtacctgtacagaaaattgaatattgaaaaattgacaaattgtgacaaacactaaaaaaaaact

SEQ ID NO: 16088 - DNA, 465 bp, Homo sapiens
agtgctagcgatgtactgtgctctgcatgtattttgactacctgaagatcttatcagagacaccagaactttaccatgaaagtggcttggcaacatttctccgtttgtaatgctttaacaggtgtagaagaatcagtgagacaaataaaacaatcaatacttaatgaagtctggcagaaattttggaatgaggttgtgactgatttggaaggtttccttccagtggtagaagaaattgaaaatattgtaacatctgcaaaccatttgaatagtgaaggccttgaagacattgagttaagtgacattactgaattgttagactctcaccttcaaaagatagttgagaaatattttggagatgtgatcacatcaaaaggcaatagaagaagccagcataggttaacatccagaactctaagaatgttcaagtatctactccacaaatgaaattgtcacaatgattcc

SEQ ID NO: 16089 - DNA, 347 bp, Homo sapiens
aaccaaatatcccgtatggaaattaactatttttatgtgctaaaactttttgcttaattgctgcaaaatacaactttgtatttggtgatgagcttataaacctgaagattttggctgctaaagatagtaaaaatctaagtatatctaataggtctagttttactattaacaatatattatctgatgtatctggcaagaaacatttcagccagttgtggtggctcagcccagaaatcccagcactttgggaggccgagttgggcagatcgcctgaggtcaggagtttgagaccaacctggccaacatggtgaaaccctgtctatactaaaaatgcaaaaattagctgg

SEQ ID NO: 16090 - DNA, 364 bp, Homo sapiens
aagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcaaag

SEQ ID NO: 16091 - DNA, 444 bp, Homo sapiens
aaaaagccctcctaaagctgatgagaagggaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagag

SEQ ID NO: 16092 - DNA, 510 bp, Homo sapiens
taagttttgtaatcctagataattgcttcacgttgaaattttttagctattctgtgtaaagaatagctattcttttggcctaatttctgagaaattagaccgaaaaatctcctcaagtattgtaacagttgaaaatacttatattcaactaccaagttttgtttcattttgattctttgttataaaacatttttaagttatttgagaagtaattattagtaaaattgtatcttgataaatcatttcctcatcctgccattcccttttataaaacactgagtttttttattccttaagtcacatatcccagaaatgttttgggttgtgaatcatttgccagccgagccaaggggagaggcagggattcccttgaaatgactcttacactttttatttattttaatgacatttgtggtgcaccagaatggaatgtgctcttttaaagagctggacagtggttgcttcagactctgaatccagaaagacttgccttttaatttttaaatatta

SEQ ID NO: 16093 - DNA, 148 bp, Homo sapiens
gaaaaagggtgaagaataaaagggatatgatgacaaggttgatccacttcaagaattgcttgctttcaggaagagagatgtgtttcaacaagccaactaaaatatattgctgcaaatgtaaaaaaaaaaaaaaaaaaaaaaaaaaaaa

SEQ ID NO: 16094 - DNA, 537 bp, Homo sapiens
gacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataagcaggacctgtacagaagtgccctgg

SEQ ID NO: 16095 - DNA, 407 bp, Homo sapiens
aacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagcactatccggaaatctaagaatatcctctttgtcatcacaaaaccagatgtctacaagagccctgcttcagatacttacatagtttttgggggaagccaagatcgaagatttatcccagcaagcacaactagcagctgctgagaaatcaaagttcaaggtgaagctgtctcaaacattcaagaaaacacacagactccaactgt

SEQ ID NO: 16096 - DNA, 360 bp, Homo sapiens
ggggcatatgtttttcagccaaaacgttttcctcatgataaaatgcaactttatatgaaaagtgaaaaattctaaaaaatcacaggaatggccaggcacattggctcatgcctgtaatcccagcactttgggaggccgaggtgggtggatcagtggtcaggagttcgagaccagcctggccaacatggtgaaaccctgtctctactaaaaatacaaaaaaactagctgggtatggtggcgggcacctgtaattccagctactcaggaggcagaggttgcagtgagccaagatcacgccactgcacttcagcctggtgacaagagcaaaactccatcccaaaaaaaaaaaaaaaaaaaaaa

SEQ ID NO: 16097 - DNA, 397 bp, Homo sapiens
tgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtacccacattgggtgagacagaaaatgaatctgttctaaaatttgtaatttgctaacttgatttgagtagtgaaaactggtacagtgt

SEQ ID NO: 16098 - DNA, 203 bp, Homo sapiens
gtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaaaaaaaaaaaaaaaaaaaaaaaaaaaa

SEQ ID NO: 16099 - DNA, 388 bp, Homo sapiens
ggcgccttggggatgacactattaaagagtcagacattatttacaaaaaaattgctctaacgagtgctaataagctgactaataaagttgttcagactttacgatccctgtatgccgcaaggatgggactcccagctaatgaatttgtacatgcagccaaatttacaggaatttttttaaaaggcagaaaaacttgaaataccaacatcctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgttatatctt

SEQ ID NO: 16100 - DNA, 461 bp, Homo sapiens
agcatcatttcaaccacaggatgggcttctctagaaaatctctcctttctaggtcgagttggggtagggggtggagaggaggccccaggatcccacaacgatttaaagataaatcctactgggaaagatgacagaattgatgctatttagtgtgaagaaggagaggcttaaagatgactttgtaggccgggtgtggtggctcacacctgtaatcccagcactttgggaggccaaggtgggtggccacctgaggcaggcgttcaagaccagcctgccaacatggcgaaaccttgctctactaaaaatacaaaagttagccgggcatggtgatgggcgcctgtagcccagctacctgggagctgagcaggagaattggttgacctgggaggggaggttgcagggagccaagactgagcctgcctccagcccgggggacagaatgagaccctgctccgaaaaaa

SEQ ID NO: 16101 - DNA, 513 bp, Homo sapiens
ttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggctttactggatcccaaaagcatttaagatacatgttccaaaaactttgaaaagctaaatgtttcccatgatcgctcattcttcttttatgattcatacgttattccttataaagtaagaactttgttttcctcctatcaaggcagctattttattaaattttcacttagtctgagaaatagcagatagtctcatatttaggaaaactttccaaataaaataaatgttattctctgataaagagctaatacagaaatgtcaagt

SEQ ID NO: 16102 - DNA, 434 bp, Homo sapiens
ggcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattcctttta

SEQ ID NO: 16103 - DNA, 256 bp, Homo sapiens
gaactttgactgtttgaagttgatcctgagactcttgaagtattggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgacttaaaaaaaaaaaaaaaaaaaaaaaaaaaa

SEQ ID NO: 16104 - DNA, 292 bp, Homo sapiens
aagaataagaataacatggtccattcacctttatgttatagatatgtctttgtgtaaatcatttgttttgagttttcaaagaatagcccatagttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacatgaaaaaaaaaaaaaaaaaaaaaaaaaaaa

SEQ ID NO: 16105 - DNA, 456 bp, Homo sapiens
atggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaaggtgcgt

SEQ ID NO: 16106 - DNA, 466 bp, Homo sapiens
ggcggccggctctacttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaggctacaacattttccatcttctataaca

SEQ ID NO: 16107 - DNA, 341 bp, Homo sapiens
gaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaaaaaaaa

SEQ ID NO: 16108 - DNA, 563 bp, Homo sapiens
agaattaaatcttctatctgagagtaataatttatgatgactcagtggtgccagagtaaagtttctaaaataacattcctctcacttgtaccccactaaaagtattagtctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgctttccctacctagaatgcagatgtttttcagttatctccccatttgcaaagttgacctcaagataacatttttcattaaagcatctgagatctaagaacacaattattattctaacaatgattattagctcattcacttattttgataactaatgatcacagctattatactactttctcgtattttgtgtgcatgcctcatttccctgacttaaaccctcactgagagcgcaaaatgcagctttatacttttactttcaattgcctagcacaatagtgagt

SEQ ID NO: 16109 - DNA, 440 bp, Homo sapiens
ggacttgatatgagtggtgctgaagctaggaagagctgtgaagggtgagtctcaagtttctgtcatagcaactgggagattattgtgcaattttctaaagagaatcgggaaggagtaatggttgcttgagggaaagattgtatgcctgcagtcatggatatgttatattgaaggaattttggcataaaactaaaagtgtttataaataaattgtataaatagatccaattagaagaactgaggtccaggctattgatgcaaatttgaaagtggttagagtattgacgcaattgatgccatgggggatggagcacccatgaagaaagtggagtgtagggcacagttctgaacaacacttgcatttaatgattggtagaggagaagtcattcgcaaaagagacagtgaatgaaatacattacagagcaaagccagaggaaaa

SEQ ID NO: 16110 - DNA, 500 bp, Homo sapiens
tgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctccgcattgcctattgatacactttacaaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttg

SEQ ID NO: 16111 - DNA, 491 bp, Homo sapiens
gccattttgaatttagaggccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgtttgccattactgagtacctgggtatgtagcgactggtcgtggtaggtgtaaatgtacttgcttgttcgactgtttcaaaacatgctaattccaaagccacttttgaagtctatagtggaaaatatagatggggtgaaagatataatgtat

SEQ ID NO: 16112 - DNA, 430 bp, Homo sapiens
ctacaatatttcctcgatcttagacgcgcgcggaggcgggcattataaatatcttctggaaaagtcaagactgttcacattttatttagaatcttctcaatcctaacctatcctccatgtgacccggagacatccctagacattatatgccctaggccaacgccataatgacggtggtttaatcctagacagatacactaattattacactcctgcgcctgagggatctcaagaattttgtaggggagcctggcactttatgacttgtcacagaggataagagcaataccgctggtagacataagttattgggggagcacttacttttgactgtggtaagggcggagggtaagacaggcttagagagtttaggaaacttgcccagggaaaaaaaagacatttgagcctcatcttgaaggatgaatttgat

SEQ ID NO: 16113 - DNA, 500 bp, Homo sapiens
gagacaagaagcagtcgagaccggattagagcatctgctgagttggataacagataaagcccttatggacaaagattgagaagactgttggcgactcagcgcctgacagaatctccgtgtgctttggtggccagccagaacggatggtctggcaacgtggaagagaatcatgaaagcacaagcgtacctaacgggcaaggacatctctacaaattactatgcgagtcagaagaaagcatttgaaatgaatcccagacacccgctgatcagagacatgcttcgacgaattaaggaagatgatagatgataagacagttgtggatcttgctggggttttgattgaaacagcaacgcttcgggtcaggggtatcttttaccagacactaaagcatatggagatagaatagaaagaatgcttcgcctcagtttgaacattgaccctgatgcaaaggtgtaagaagagcccgaagaagaacctgaggagccagcagaagacacac

SEQ ID NO: 16114 - DNA, 560 bp, Homo sapiens
gaggaaccgaagaataaaggagattgtgaagaaacattctcagtttattggatatcccattactctttttgtggagaaggaacgtgataaagaagtaagcgatgatgaggctgaagaaaaggaagacaaagaggaagaaaaagaaaaagaagagaaagagtcggaagacaaacctgaaattgaagatgttggttctgatgaggaagaagaaaagaaggatggtgacaagaagaagaagaagattaaggaaaagtacatcgatcaagaagagctcaacaaaacaaagcccatctggaccagaaatcccgacgatattactaatgaggagtaccggagaattctataagagcttgaccaatgactgggaagatcacttgcagtgaagcatttttcagttgaaggacagttggaattcagagcccttctatttgtcccacgacgtgctccttttgatctgtttgaaaccagaaagaaaaagaccaatatcaaattgtatgtacgcagagtttcatcatggataactgggaggagctaatccctgaatatctgaaccttcatta

SEQ ID NO: 16115 - DNA, 186 bp, Homo sapiens
ccatcattcggtccagtgcctcgccctattagcccttaagcccaccgtttctaacacccgcacaagagccaaaccggtcgcagccggccccgtcgtttgataagacagacagaccaggtactacggaggaggccctcttaggcatcaacggtacaagggtccgggtgcttctaaataaggaagatt

SEQ ID NO: 16116 - DNA, 248 bp, Homo sapiens
agaacagataaagattgtgtggtgttttggatttgtttgagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaagacaaaaaaaaaaaaaaaaaaaaaaa

SEQ ID NO: 16117 - DNA, 276 bp, Homo sapiens
ctccaagaacactggaccagcacctccacccacatgaaattatttttattcttggatctctctacaagggaccaggctgtttcaggaaaaggactaaaaagttcatctccatctcacccacagtgtagactggcacaaggcctgccacaaatttgaagcttagtatgtatgcataatattttcaaaataacaataataaaataaagacataaaacacaattttgattggaaggaggcttgtatacacttctaataagagaaatccccccaaaaaaa

SEQ ID NO: 16118 - DNA, 555 bp, Homo sapiens
cagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatgggattttg

SEQ ID NO: 16119 - DNA, 540 bp, Homo sapiens
atgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctca

SEQ ID NO: 16120 - DNA, 545 bp, Homo sapiens
gagcccctttgagggcaggggctgtgccttgctcttcttggcaccccaaatcaatctatgctaaatgaacaaaaaatcaagtcagacattctcctatgacattaaactccacaactcttttctaatctagtacaaaatttcattcacatgactcaggagttttctactctgtaacaggtatgaaccagctgataaacgctggctagggactgctacatacaagaaaaactgacagtattcctcacctttgtgggagagagtgaggctatgctaagacaatcattttgcagggtgcgttctgcaaggattgagcactacacacagctagggtgccaacagtaagtagttttaagtcatttgacaacaaataattactgagcacgtcctattctcaaggtgtaatgctaggcagagaacacacagacagtatttcatttacaaatggattgtgttacaaaagttttcagcaagacagatggttgtaacatgaaaccttttcacaagcaagcaagcaaataatgacaaggaagattctcaggcttgcc

SEQ ID NO: 16121 - DNA, 252 bp, Homo sapiens
gcctaacgagcttggtgatagctggttacccaaaaaatgaatttaagttcaattttaaacttgctaaaaaaacaacaaaatcaaaaagtaagtttagattatagccaaaagagggacagctcttctggaacggaaaaaacctttaatagtgaataattaacaaaacagcttttaaccattgtaggcctaaaagcagccaccaataaagaaagcgttcaagctcaacaaaaaaaaaaaaaaaaaaaaaaaaaa

SEQ ID NO: 16122 - DNA, 541 bp, Homo sapiens
gcaccagctgtccaaccagtcccagtgagatgaaccaggaacctcaattggaaatgccaaaatcaccagtcttctgcgtcgatcacgctgggagctgcagaccggagctgttcctattcagccatcttggaacggaccagccctggataactttttaaactcatttatttagtcacctatatatgttgataacagtggtacagatagagactgtctaaaccatggaaagataactggaatctgaaatgagaaaatgtaagttcagatagtggcacaaccaagtaatagtttgtggtttttaaagcacatcaatgaaattatatttttatgcaaagtatagtaatataataataatgctaactagcccacagagttgtttatgggttaaatcaaatattatatgtgaaaagtgttttataaactgtcatatactccccaaatattagttacctgatatttttgaacttattagaggcatttactttaataattttcatttatacatatacttaaattgtataaggataaacattttaaagta

SEQ ID NO: 16123 - DNA, 503 bp, Homo sapiens
gaccagaaagaaggaacaaactctggtgaaagcactggggctagaaatagcttagtttttaagaataagaaaaagtcagtgagctctaaatgtagggagaaaggaggtaaagttggaaagataagcagagaatatgtaggaatttggaggtctggtaagtgcaattcatactcccttcgtaatcctagtacataattcatatgtagtacatataagaatatcatgcatattaaagaatgcatcatctcaagccaatgaggagctgatgggctattcaaaaagtggtgttggatgcatttgttgtttgtgcaaaaacataatattcttacatcaaaccatacaacaaaataaattacaagtggatttacaaacttaacataaaaacccaaaccataaaatactagaaggaaacatggaaaaatatgtatatgagtttagtgtaggaaagaattttctaaacatgaaatcagtttagaaaaaaaaaaaaaaaaaaaaaaaaaaaa

SEQ ID NO: 16124 - DNA, 396 bp, Homo sapiens
agaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcaaaagtaaaggaaaccgtctgagcaagaaggtgctaagaatgatgtgaaagattctgacacgtgtgtatcagagagcaatgataattcaagaacaacagctacagttccacaaaaaaaaa

SEQ ID NO: 16125 - DNA, 565 bp, Homo sapiens
atatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcttccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccacgctcaggctctcagctctcgggccagtgctctgctctgtccagggtaggtaatactgggagactcctgtctttacctcccctcgttcagacctgcctcatggtggcaacatgg

SEQ ID NO: 16126 - DNA, 252 bp, Homo sapiens
tgctaatgttacaaccaaagcagccaccccacctcctctcgtgttgagcctcacgaccgctgacccagctggaaagccagcgccctgccgcgtcaccctgactctgctcagagccagcattccagccacaaagagggcctccttcctttcctctttcataaaagtgttttttgaagagttagagtatattttaggctttttatctttattaaaatttcatgtgcaaaaaaagaaaaaaaaaaaaaaaaaaaa

SEQ ID NO: 16127 - DNA, 550 bp, Homo sapiens
ggatgatggccacccacattatcgaggataatctcttaaggtgaactgattgtacatgttaaccacatctacaaaacaccttcacagcaacacctagattactgttgattgaataagcacttcctatagtctagccaagttgacccataaaatgaaaccatctaagagccacagccactcaaacacactgcaggattttaagcagaggagtgccgtaaggtgtctgtgatttaaaaggatcaccctgaatactgtgctgagaacagatcatagggtgcaagaatggaagaagggagagcagctgggagccttttgttgtaattcagatgagagataatgagggcttgggccagcatgggaaccatggaggtggtaagggaatgggccgttttctggatatattttaaaatagagccaataaaaattattaatggaccagacgaggggtgtaagagaaaaaagaggagtcaagaatgacctcagagcaaactgggaaggatgaagatgcaatcaactgtacagggaagacagaggtggagcggctttggca

SEQ ID NO: 16128 - DNA, 341 bp, Homo sapiens
aaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaatttattaattacaaaatgaagatttataccattgtggtttaagctgtactgaactaaatctgtggaatgcattgtgaactgtaaaagcaaagtatcaataaagcttatagacttaaaaaaaaaaaaaaaaaaaaaaaaa

SEQ ID NO: 16129 - DNA, 480 bp, Homo sapiens
tcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttgtttctgcttcaataaatctttggaaaaacc

SEQ ID NO: 16130 - DNA, 274 bp, Homo sapiens
agccacacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcacaaaaaaaaaaaaaaaaaaaaaaaaaaaa

SEQ ID NO: 16131 - DNA, 406 bp, Homo sapiens
taaggaaatatttttagtttctgaagttgtagcattcttcagttatttacattttactagaacagaaaccaaaaccacatttttatgctaactttcttatttgctttcccatgtgtgaaaatctttgtttattgtactccattcagaagctgtatttcttcaaaatagtaagggtttcagcagagacaccttattttctttaaaaatacaaatatttctaaaatagcattttttaaaaacttgctttcattcttcaagttggtcactcttgctatgcctttgatcctctaaaataatttctgacatatataaaagggcaacttgacattcgctgattgaatatgtagtagttgttcacaggaatttaaatttcttttataacctttacaacttccaaaaaaaaaaa

SEQ ID NO: 16132 - DNA, 204 bp, Homo sapiens
tcaagtcatttggctaaatcatattaaattgcaatcacctaaaatcccctggctattttgacttaaatgactgtcatctttggtttcccttacttagaacgtcacacagttaattttttttttcaacctaatggcaagtgtgtgtgtgtgttcttggagtagttctgctggctatgaagagtatgtagtaatatgctaaagctt

SEQ ID NO: 16133 - DNA, 259 bp, Homo sapiens
accaccacgcctggctaatttcgtatttttaatagagacagggtttctccgtgttggtcaggctggtctcaaactcctgacttgaggtgatctgcccgccttggcctcccaaagtgctgggattacaggcgggaaccactgcacccggcaggtacagtgtttctttaggtgctggtggtacaccagggaatcagggcagaagctggatcctgcaagagtaatgtttgagaacaaataaatactttcgaaaggaggtcga

SEQ ID NO: 16134 - DNA, 571 bp, Homo sapiens
tgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagat

SEQ ID NO: 16135 - DNA, 364 bp, Homo sapiens
ggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaagagaaaaaaaaaaaaaaaaaaaaaaaaaaaaa

SEQ ID NO: 16136 - DNA, 168 bp, Homo sapiens
gatcttggtcaataactgggagatggacaaactagagatggaagatgcagtcacatttttgaagactaaaatctattcagtagaagctcttcctgttgctgctgtaaatgtgcaaagcacacagtaaagtgaaaatcaaccttttcaaaaaaaaaaaaaaaaaaaaaa

SEQ ID NO: 16137 - DNA, 332 bp, Homo sapiens
atgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtggaaaaaaaaaaaaaaaaaaaaaaaaaaaa

SEQ ID NO: 16138 - DNA, 559 bp, Homo sapiens
ggaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttg

SEQ ID NO: 16139 - DNA, 466 bp, Homo sapiens
aactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgg

SEQ ID NO: 16140 - DNA, 519 bp, Homo sapiens
gcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgttgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgca

SEQ ID NO: 16141 - DNA, 342 bp, Homo sapiens
ggtccttgctctcaaaataaatatattgaacatttacaacagaatgaatgccttatgaatgcaagcttttcttttattgcaattctaaccaatcaatcaaacagaccaaaaggtcatacttctaaaataagctacaagtaatctttttctatgaaaatgatgtgacttggtgccacagctaaactttatctaatagcagcatcatcagcccatggcagcaaagaaatgttaatttctggcatcccatgggctcttaccgaagcaacaacttcataaagcatgcagatatctattctgctgaagtttcaaacaaacaaaaaaaaaaaaaaaaaaaaaaaaaaa

SEQ ID NO: 16142 - DNA, 539 bp, Homo sapiens
gcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgcaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagat

SEQ ID NO: 16143 - DNA, 277 bp, Homo sapiens
ctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16144 - DNA, 562 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtcgatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccaattttttttttttg

SEQ ID NO: 16145 - DNA, 366 bp, Homo sapiens
gtaaaatggaggccattgtgtgagcctatcagagttgctgcaaacctgacccctgctcagtaaagcacttgcaaccgtctgttatgctgtgacacatggccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgattttttttttt

SEQ ID NO: 16146 - DNA, 531 bp, Homo sapiens
gaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaattttcgtgctaacattaaaattataactttttgaaaggtaatagatttccagaagtaaaatctgatggttctaaatcaatcaatgtgatagttcatttttaactcttagaagaattcagaggaaattaacccactaagtaaaaatctgtct

SEQ ID NO: 16147 - DNA, 333 bp, Homo sapiens
cctagcctttctattagctcctagtaagattacacatgcaagcatccccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccgaaaaaaaaaaaaaaaaaaaaaaaaaaa

SEQ ID NO: 16148 - DNA, 569 bp, Homo sapiens
ggcacgccggaccggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcagctcttcccttcatcacatacttggagagcaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttattagaggaggaggaggagtcaggtgaggaggctgcagaagcaatggagtgaacctctggctccccacacagctggctacactggctcaaggcttca

SEQ ID NO: 16149 - DNA, 506 bp, Homo sapiens
tcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtgggggggggtctgccagctggggccctccctgtcgtcagtgggcacttttttttttccaccctggctccttcagacacgtgcttgatgctgagcaagttcaataaagatcttggaagtttaa

SEQ ID NO: 16150 - DNA, 136 bp, Homo sapiens
accatagttttatatctgtgtggtgttttgtaccggcacgggatatggaacgaaaactgctttgtaatgcagtttgtgacattaatagtattgtaaagttacattttaaaataaacaaaaaactgttctggactgc

SEQ ID NO: 16151 - DNA, 589 bp, Homo sapiens
ggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggttactgtaatagtgtgctgttcatggaaaccgagggctgcatctgtttatagtcatcttgtactgtaattgatgtacacaacattaaaagtactgacacctg

SEQ ID NO: 16152 - DNA, 395 bp, Homo sapiens
agggaggggaaactttttttttttctgtagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcggaataaaagcaaaaaaaaaaa

SEQ ID NO: 16153 - DNA, 506 bp, Homo sapiens
tctctgatatattgtgaacacacttggtcatatagtatcagagaaagtaaaaataaataaaacacaattcttgccttaaatagcttataattgattgccagcacacagctttagcacccagacagaatgaaacaaatgttacaatagccatctgttgacattttaataagaatttgacattgggtgcagagatgaacagaatggaggaagaagtaagaaacttgaaaggtaagaaaagggcagaggtgaaagatcttaaacattatgccaaggattttgttctttatcctgaaggcactgaggaccattgaagatttttaagaagaaatgacctgccagagctagcataaactggcggctgagagcctagaaagagaaaccagccaggagccaatgaggcctgaaagagtagagcaggaaacaaaatgtaaagaaggaatcgtatttgtaaaacatagaagtagaatcagaagaactcagtactgctcaaatgttgagagtatggg

SEQ ID NO: 16154 - DNA, 500 bp, Homo sapiens
gatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttccagagatacttttcatttaacagcttttgttaagtgtcaggctgcactttgctcatataattattgttttcagatttcaact

SEQ ID NO: 16155 - DNA, 396 bp, Homo sapiens
ggttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgctttattgttttggggagattttttttccttacatgattatattaaacactttaaaatagccttccggtttctggattttgagaagcctgatctgtattgtgtgg

SEQ ID NO: 16156 - DNA, 509 bp, Homo sapiens
tgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaaggttagtttaaaaggtgtaggtgattaaaataatttgaaggcgatcttttaaaaagagataaaccgaaggtgattaaaagaccttgaaatccatgacgcagggagaattgcgtcatt

SEQ ID NO: 16157 - DNA, 328 bp, Homo sapiens
gaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagaaaaaaaaaaaaaaaaaaaaaaaaa

SEQ ID NO: 16158 - DNA, 512 bp, Homo sapiens
gtattaaggataacaaatgactcacaaataatgaaagcaggaagaaatttttaaaaagcagaatgcattttaaaaaatgacctcaatttagactactgaaggacttccctcttgttatatctctgtgtgtcatttattggaaagcaagaaataaaaaaaaatctgcattgtacacaaaagtgcccttgtaaccagaattagtttagtgcagattaaaggcatagaaagaaaagtaaaatactgaattataaggtgaattctacaatgcaatcttggtggagttatttcaaaaggataattttaaaacgtaaatattttggggtgcattagtagattaggaaaatattttcaaagaatatcctcagcaattatattggagatctcctataatagttaaaaagtttgatatgcataaggagagtgttgagacacagcctctgaattttctgtataggcttgctaaggagagcaaggagatgggagaaaacaaaatttctctgggtaaaatttgg

SEQ ID NO: 16159 - DNA, 503 bp, Homo sapiens
accgggaggtagaggctgcaatgagccatgattgtgccgctgtgctccagcctcagagacagagcagtaccacaaaaagagttagaagagttctttatctaacaaatatgagttgtatatttgcatagttgattgcattcatggagtctaagtatttttttattcattaaatctaaaggaagttggggctctctgctttcgataagatgaagtaacaagtactgtacttacccttcacctaaaataatgattaaagaaaatttgtgtgtttatttcttaagacacagaacaagcatttgataaaatccaacatccattcctcataaaatcactcctgaaactggtgatagagaggaacttcctcaacctgataattagcatctataaggaaccaatggtaatattatatttactggtgaatgtctgaatgctttctcactaagatcaggaataagacaaggatgtctactttcactacttctgttcgatactgtactgcaggt

SEQ ID NO: 16160 - DNA, 198 bp, Homo sapiens
gaggaaaccgcagacaagatgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaaaaaaaaaaaaaaaaaaaaaaaaa

SEQ ID NO: 16161 - DNA, 311 bp, Homo sapiens
atttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16162 - DNA, 374 bp, Homo sapiens
tgatggccaacccacctctaatgctggccagtctatcttacacaaagttttaagttttcctggtgtcatagtactccatagtctcccttaaatcctttcttgaaatttctgaacatatttcctagtggggtgggcttactttgtgcctgacccatgcttctttgagacaaaacaccatgctcacaccacacgcacaccacaaagaacaggtaaaaagggcacacacacacttttacagtttacaccaaaccagaatcaaaaccaaaatcagagtatcaggaaatccaagccaggtcaaaaccaaaaccaaagtatcaagcaatccaagtcaagtcaaaaacaaaaacccaaaaaaaaaaaaaaaaaaaaaaaaa

SEQ ID NO: 16163 - DNA, 344 bp, Homo sapiens
aaggagatagagacacaaaaacccttcaaaaaatcaatgaatctaggagctggttttttgaaaagattaacaaaatagatagactgctagccagactaataagaaaagagagaagaatcaaatagacacgataaaaaatgataaaggggatatcaccactgatcccacagaaatacaaactatatatatatatcggagaatactataaacacctctatggaaataaactagaaaatctagaagaaatggataaattcctgggcacatacaccctcccaagaataaaccaggaagaagtcaaatccctgaatagaccaataacaacacatacagcaaaaaaaaaa

SEQ ID NO: 16164 - DNA, 513 bp, Homo sapiens
atgcaaacttctaatggtattttctgaaactttttcagtactgatgggattataaatttagagtacctttgtgggggatattttggcaatattgactgagattaagaatggacatatatcttgatccagtaattccacctccaggaatttatcctataggtattctcacccatgtgtataataatatatgctcaaggctattagtggcagcactgattgtcataaaaattagaattaaccaaaatggcatctctacagggattgctaaataaattgtggcacactgataaaaatagattactatgtatctgaaaaaagaatgagaacgcataccatatctgtagaaagataactgataacactggttgcctttgggaaggggaactgtaactggggacagaggtgggagaattttcattgcagtcatttgtgtcctttatgttttgaaccaaaagaaggtattacccactcaaaaatagatttgacacttcttaaatgtcactgaaatgaaac

SEQ ID NO: 16165 - DNA, 370 bp, Homo sapiens
tgcccctcatttacataaatattatactagcatttaccatctcacttctaggaatactatgtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaaaaaaaaaaaaaaaaaaaaaa

SEQ ID NO: 16166 - DNA, 575 bp, Homo sapiens
cagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagtcgatgaaagtgagaaaactaaggagagtcgtgagcagttgagaaagaatttgagcctctgctgaattggatgaaagataaagcccttaaggacaagat

SEQ ID NO: 16167 - DNA, 476 bp, Homo sapiens
gaagccagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactgggtctgacttttttcctagagatttctccctgaaaaatacaagggctgttggtgagagcagacttgaggtgatgatagttggcctctggtctacaaagatttcataactccttggaaagcttcttataatcattcttaacttcttg

SEQ ID NO: 16168 - DNA, 524 bp, Homo sapiens
gagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagttca

SEQ ID NO: 16169 - DNA, 542 bp, Homo sapiens
ctggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatataataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatgga

SEQ ID NO: 16170 - DNA, 310 bp, Homo sapiens
taatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatacccatcgtcctagaattaattcccctaaaaaaaaa

SEQ ID NO: 16171 - DNA, 551 bp, Homo sapiens
gaggcattgaggcagccagcgcaggggcttctgctgagggggcaggcggagcttgaggaaaccgcaggtaagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagac

SEQ ID NO: 16172 - DNA, 541 bp, Homo sapiens
aagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgcatctgagcagtgataccagccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaagaaatgtactgttaaggtattactttttttcatgcgg

SEQ ID NO: 16173 - DNA, 313 bp, Homo sapiens
atagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaa

SEQ ID NO: 16174 - DNA, 470 bp, Homo sapiens
gcagaccatccacatcaatttatgagaaaaaaattcatcttattcatgcctaactgaagagggccaacaattcacagaagaagcaatggccaaacaccataggcatctcagttggtttagcttacacaattctgactaaaaaatcaaagttgaacaaattttccactcaatgggtgccaaaactgttgtgctaagattagctgcacacaagagctttcagtgaaaaattcaaacaattggcattgagatcctaaagcatttctcgaaagaattgtaacagcagatgaaacatggttttgccagtacaatcctgaagacaaagcacaatcaaagcaatggctaccaagaggggcacatggtgaagagcaaaagtcatggcaatagttttatgagatattcaaggcattttgcttggtaactttctggagggtcaaaagaaaataacatctgcctccgtcccaaaaaaaaaa

SEQ ID NO: 16175 - DNA, 245 bp, Homo sapiens
aatacatttttaaaaggaaaaaagaaaacggagagaaaaaaaggtgggtcattgacggactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaactcttaaaaaaaaaaaaaaaaaaaaaaaaaa

SEQ ID NO: 16176 - DNA, 300 bp, Homo sapiens
ggggattatcaagtacgatattatcgtcagaaacctgtaacattacttctgatttgggtgtgcatttcacaaaatataggggaagctgtatcgcagcaaatgtgaaatgatggagaaatttcagaagcataataaagttcacaataaggataatactttatataatgtataaagtatatataatataagatatatgttatataaactgcacattatattcaaacttaaaagtgagctttttttttaaaggcccaaaattgtacagggatacaaggagctatttctaaaatttggctgatg

SEQ ID NO: 16177 - DNA, 259 bp, Homo sapiens
aggaatgaatagtattatggcatctataagcagggactgactttaaataaccctaaaactgtaaaaattgccttaaaaatataaaggagtttaaaaactgtctgttgtgtatcatgcttaaagatgctgattagaccatgaatatgtgtctgtaataaacccgaagtgagactgtttctttcatgttgattgagccaagacttgccttcacgttacattccaggtcctctaaaaaaaaaaaaaaaaaaaaaaaaaaaaa

SEQ ID NO: 16178 - DNA, 486 bp, Homo sapiens
gtctattgcaaggaccttctttgctgccagttatcataggccgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggttttgtgggtgtgaaacaaatggtgagaatttgaattggtccctcctattatagtattgaaattaagtctacttaatttatcaagtcatgttcatgccctgatttatatacttgtatctatcaataaacattgtgatacttg

SEQ ID NO: 16179 - DNA, 455 bp, Homo sapiens
ataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatacccatcgtcctagaattaattcccctaaaaatctttgaaatagggcccgtatttaccctatagcaccccctctaccccctctagagcca

SEQ ID NO: 16180 - DNA, 555 bp, Homo sapiens
gttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggttcatgatctctaagatcaagtaaaaatcataatttttacttattaaaaaattgcaacacaagaccaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttgggagtttagcg

SEQ ID NO: 16181 - DNA, 474 bp, Homo sapiens
ggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaaccttgtagagagagtaaaaaatttaacacccatagtaggcctaaaagcagccaccaattaagaaagcgttcaaactcaacacccactacctaaaaaatcccaaacatataactgaactcctcacacccaattggaccaatctatcaccctatagaagaactaatgttagtataagtaacatgaaaacattctcctctgcataagcctgcgtcagattaaaacactgaactgacaattaacagcccaatatctacaatcaaccaacaagtcattattacccccactgtcaacccaacacaggcatgctcataagggaagggtaaa

SEQ ID NO: 16182 - DNA, 168 bp, Homo sapiens
tagcccatgcctgtagtcccagctactagggaggctgaggcaggagaatcgcttgaacctaggaggcagaggttacagtgagctgagatggtgccactgcactccagcctgggtgacagagcaagattccgtcgaaaaaaaaaaaaaaaaaaaaaaaaaaaaaaaaaa

SEQ ID NO: 16183 - DNA, 330 bp, Homo sapiens
gaaacaattcggagaggatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattgcaaaaaaaaaaaaaaaaaaaaaaaaaaa

SEQ ID NO: 16184 - DNA, 184 bp, Homo sapiens
agggcccgtttgttcaacgattaatagtcctacgtgatctgagttcagaccggagtaatccaggtcagtttctatctgtaaagctattttttcctagtacgaaaggatcggaaaaagggggcccatactaaaagcacgccccaccctaaatttatgaaaaaaaaaaaaaaaaaaaaaaaaaaaa

SEQ ID NO: 16185 - DNA, 249 bp, Homo sapiens
gggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgataaaaaaaaaaaaaaaaaaaaaaaaaaaa

SEQ ID NO: 16186 - DNA, 503 bp, Homo sapiens
agccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcaagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgt

SEQ ID NO: 16187 - DNA, 511 bp, Homo sapiens
ggccagtaaatgttacatctactaaacacttttaaaagaaaggtccaaaccccacactgaaatattttattgaggcagagtattataggtgattgaaatgttcttagtacaatttcatggaagtaaagggaagatatttgaaagtatgtggtgaggagattctgaaactttccagtgtctttatgctggttagcatttgtaatcattaaggtgcaaaaaatgttatttttgaatatttttggcattgtatatgtaatttgtagttagctatgactgtggcttcatattagagattaaccccatcaagaagttaacagtctcccagtttagtatgactttcatatttgagaaacttgtaagcttgtctgtttacaaaatgtaatctacttactgttcctatatttttcttaatgttttgggttaaaaatggtgtattaaacagctgggtttagtggtgcgcacgtgtggttcagctactcaggcgggaggatgacacttgagcctggggtgt

SEQ ID NO: 16188 - DNA, 513 bp, Homo sapiens
tctttctttgctgcgtctactgcgaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcaacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactgactaccgttcggactatttgagtcatgtacagaacatgatcaagggtgtacactgggcttccgtacaagatgaggtctgtgtatgctcacttccccatcaacgttgtatccaggagaatgggtctct

SEQ ID NO: 16189 - DNA, 387 bp, Homo sapiens
ctcaaaaaaactattatgaaagtcaataaaatagataatttaacaaaagtacaggattagaacatgcttattcctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataattcctcaaagtaaaattgagaaatctttaagtttttttcaagtaacataatctatctttgtataattcatatttgggaatatggcttttaataatgtcttcccacaaataatcatgcttttttcctatggttacagcattaaactctattttaagctgttttggg

SEQ ID NO: 16190 - DNA, 370 bp, Homo sapiens
aaccgagacagttgcatcattggctatgatggaattattattgtattttaaaaatgcatattgatcactatgattctaaaacaattttttaaataaaccagcaggcgctaaaagaaggcattttatctaaagttattttaataggtggatagcagtaattttaaatttaagagttgcttttacagttaacaatggaatatgccttctctgctatgctgaaaatagaagctatttattatgagctctacaggtatttctaaatagagcaagcatggtgaatttaaaatatgaataaccccacccaacaattttcaggttatttttgcttgggccgaccttggggggggtcatcacccatcagtattgggag

SEQ ID NO: 16191 - DNA, 278 bp, Homo sapiens
acatgaaacatcctatcatctgtaggctcattcatttctcttacagcaggcatattaataattctcatgatttgtgaagccttcgcttcgaagcgaaaagtcctaatagcagaagaaccctccataaacctggagtgactatatggatgccccccaccctaccacacattcgaagaacccgtatacataaaatctagacaaaaaaggaaggaatcgaaccccccaaagctggtttcaagccaaccccatggctccatgactttttcaaaaaaaaaaaa

SEQ ID NO: 16192 - DNA, 358 bp, Homo sapiens
gaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16193 - DNA, 475 bp, Homo sapiens
atagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgtttacctctaaataaatgaattcagagaa

SEQ ID NO: 16194 - DNA, 537 bp, Homo sapiens
agacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatt

SEQ ID NO: 16195 - DNA, 560 bp, Homo sapiens
gcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccccagatcacttataatacgtaatacaatgtaaatgccatgtaaataactgttatactgtattaaggaataacaacaagaaaaatgtacatgttcagtacagacgcaatttttttg

SEQ ID NO: 16196 - DNA, 455 bp, Homo sapiens
ggtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatt

SEQ ID NO: 16197 - DNA, 553 bp, Homo sapiens
gagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacatgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaatcaaaagagacaaaagacatcttcga

SEQ ID NO: 16198 - DNA, 545 bp, Homo sapiens
agaatcaaacattttgaaagtctgtccttgaaggaccaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttacatctcagtatgaattattcaatttatttgaatgattttctttacaaaacaaactcattcattagtcatgtttatctgctaggagttagggaacaatttggcaattttgtggtttc

SEQ ID NO: 16199 - DNA, 491 bp, Homo sapiens
cgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaaca

SEQ ID NO: 16200 - DNA, 333 bp, Homo sapiens
cacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggt

SEQ ID NO: 16201 - DNA, 529 bp, Homo sapiens
gaacactagtatactaactaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctggtgttggtgataaaatggttgccagca

SEQ ID NO: 16202 - DNA, 502 bp, Homo sapiens
gaaagaaatattgagcaaaaagaacaaagctaaaggcatcacactattttacatcaaaatatactacaaagcaatagtaaacaaaacagattgatactggcataaaaatagacacatagatcaataaaagagaatacagaacccagaaataaacttatgaacttatagacaaatgatttttgacaaaagcaccaagtatatatactggggatatgacagtctcttccacaaatgattctgggaaaactggatttttaacacatgtagaagaatgagactagacccctatctctcaccatataaaataattcaactcaagataaagacttaaaggtaaaacctgaaactataaaactactagaaggaaacacaggggaaatccttcatgacattgatctgggcaagaattttttggataagaactcaaaagcacagtcaacaaaagcatatagacgaaatgttatcaaactaaaatgcctctgcacagcaaagaaaataatca

SEQ ID NO: 16203 - DNA, 614 bp, Homo sapiens
gctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacagggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttgg

SEQ ID NO: 16204 - DNA, 463 bp, Homo sapiens
atacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatacttttttttcttcaattttgtaaacttcctggaaagctgtcttcactaagtatcccctagtctctatatatgtgg

SEQ ID NO: 16205 - DNA, 490 bp, Homo sapiens
aagctgacaagcattcgggccgagatgtctcgctccgtgtttcttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttggctttcagcaaggactggctttctatctcttggactacactgaattcacccccactgaaaaagatgagtatgcctgccgggtgaccatgtgactttgcacagcccaagataggtaagtgggatcgagacatgtaagcagcatcatggaggtttggaagatccgcatttggattggatgaattccaaattctgcttgctgccttttaatattgaatgctatcactcacactttatgcccaaaag

SEQ ID NO: 16206 - DNA, 593 bp, Homo sapiens
aatccagaggaacaagcatgtctctctgccaagatccatctaaactggagtgatgttagcagacccagcttagagttcttctttctttcttaagcccttttgctctggaggaagttctccagcttcagctcaactcacagcctctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataatt

SEQ ID NO: 16207 - DNA, 367 bp, Homo sapiens
aaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatg

SEQ ID NO: 16208 - DNA, 348 bp, Homo sapiens
cttcagctaagtcctgtcagttctacctcaagtctttcccgtctttcttcctcacctatgtaatttcagtagtctctcagcttcacttaacctcttactccagcctactttatacacaatgttagattcatcttactgaaacatagttctgaccatgtattccatgtatgtgttctctctcccctattagactgtaagctccttatgggcaggatctgtgtctgagtcatctttgtatcttgcctagcacctatcaataaatacttcttgaatgaaaaaaaaaaaaaaaaaaaaaaaaaaaaaaaaaaaaaaaaaaaaaaaaaaaaaaaaaaaaaaaaaaaaaaaaaa

SEQ ID NO: 16209 - DNA, 567 bp, Homo sapiens
ccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggattctcagtactggcgttttaccaatgatataaaagatgcagggtaccccaaaccaattttcaaaggatttggaggactaaccggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggacct

SEQ ID NO: 16210 - DNA, 505 bp, Homo sapiens
agcccaaaatctccttaagctgataagcaacttcagcaaagtctcaggatacaaaatcaatatgcaaaaatcacaagcattcttatacaccaataacagacaaacagccaaatcatgaactcccattcacagttgcttcaaagagaataaaatatctaggaatccaacttacaagggacctgaaggacctcttcaaggagaactacaaaccactgctcaatgaaataaaagaggatacaaacaaatggatggatgaacattccatgctcatgggtaggaagaatcaatatcgtgaaaatggccatactacccaaggtaatttatagattcaatgccatccccatcaagctgccaatgactttcttcacagaattggaaaaaactactttaaagttcatatggaaccaaaaaagagcccgccttgccaagtcaatcctaagccaaaagaacaaagctggaggcatcacacatatctacaactatctgatcttgacaaacctgacaa

SEQ ID NO: 16211 - DNA, 164 bp, Homo sapiens
aggctagccaaagtatcctatcattcagccatagtgattagttcaggaatgggcagattaacaaaactgaagttaatcagagatagtcttatcatttgggctagcactatcaagaaaaagacacctgcttctggaataaaaaaaaaaaaaaaaaaaaaaaaaaa

SEQ ID NO: 16212 - DNA, 520 bp, Homo sapiens
ggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcc

SEQ ID NO: 16213 - DNA, 563 bp, Homo sapiens
cataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgatcgcatgtggttaatgttgcattagagcactttgcaattgcataattcattaatgttttgtgagcttgcatttgtgagttattggatgatcagactgaatttgtcaagtatcacattgtacatctgcctagatgtcgatgactgcagtaataatacagtttataatgaactatc

SEQ ID NO: 16214 - DNA, 310 bp, Homo sapiens
gttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggggaaaaaaaaaaaaaaaaaaaaaaaaaaaaaaaaaaaaaaaaaaaaa

SEQ ID NO: 16215 - DNA, 446 bp, Homo sapiens
gtacgtgaaagtgctcatccaggtgggatatgagcctcttcctccaacaataggacgaaatatttttgggcggcaagtgtgtcagcttcctggtctctttagttatgcccagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatc

SEQ ID NO: 16216 - DNA, 365 bp, Homo sapiens
gaagccctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtt

SEQ ID NO: 16217 - DNA, 420 bp, Homo sapiens
gaaaaccaaaatactcataataatgatgaagaggaagatgacagttattaaacttggagaaaaaatcagttctcggttctcatttaactgtaaactagggttaaaatgctaagtagaatacacttcctaacagaaatggaagttaaatgtcatatctttttgcctaagaacttatacggcatatcaacattgttggaagaaaacaggaaggagtaaatatctaagtatgtacatataaacttatacaaacaaatactacagaaacattactatatgtgatatagtaatcataacaatgtctggaaatatcaaactttgggttaaaattacttttgagtttagttcaaaagaatgcagagaagacattctagaaatacttagaatagctcacgttagctacgttttttcacaaagatgcat

SEQ ID NO: 16218 - DNA, 506 bp, Homo sapiens
atttgccagctaactttccatcatgtcttggtaaaattgctcagttaaatataattggccatctacttattaaaaaacaattcaaataatctgtacagttaccataatttgacaacaaattactttaaatttagcaccatcttagaaatcttcttaatataaactactgattgaaatgtgtttatactttctatcatatttcaaactgttttactttccttgcattaagacaattaaaacacaaactacatgttagaatgaataatttaaaggacatgctgctgtttcagcataaaaaatggtaaagtctttataaatagaatacttatgatagccattaacgtattgaattgtttaattaacctagttgtgattttccgaatttaagacgttttcttactacatgtgttaaattgtacctataatatcttcctggaaaaatagaagtatttgtaaggttttataaatgcacaatttatgtataaatataattggatctggaaaaa

SEQ ID NO: 16219 - DNA, 450 bp, Homo sapiens
acaagaccaagcacgcaaaacaaattgcaatataatgtgattagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctcttctgcttgcgcaaggttcctgggctggaccggttcaacagagaggcttatttgactttatgctagaagatgaggcttctgggataggcccagaaggtcctgatgaccgcgacttcgagccctcctaggccagtgtgcccttccgctgcaatgccatcttcgaggggccagggtctgattgggctggacaaagggccaaaggatcttcccctgacacaa

SEQ ID NO: 16220 - DNA, 356 bp, Homo sapiens
aaaaaaacccagtatttaaagtctattaaaaatactcaaattagtgggccttcgagtttaaaataggcattgttattttacattctaaagtgcatgtaggttcgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgagaaaaaaa

SEQ ID NO: 16221 - DNA, 199 bp, Homo sapiens
attgaatgctatttctggcataagaaactgctgaagaaaaataggttgaataagctaacacttgtcgtctctttgtaggatatagaagacttagatcactatgagatgaaggaagaagagcctattagtgggaaaaagtcagaggatgaaggaattgaaaaagaaaatttggcaatattagagaaaaaaaaaaaaaaaa

SEQ ID NO: 16222 - DNA, 470 bp, Homo sapiens
gtgggcgaggagaggaagggcgagtgtgaacaagcagggaatgctggactcctactaggctgtctatctagctaagatgattatgattcaaggaggaagtacaaaatggtattaaggctctcttcctccacccttaaaaatgtgggtaaagataagctacattttcccagaatctgctcaaaacaagacaaaagcgatgtactgagccaggtgaggaagaaaggcagtgcaccccacagacaagactgccctggttgtacggtgctacaacatgatctcagttgctgttaaataagtttcgcaagaaactgaagaatggaaagacaagagatgaggaacaagtttcagagaacagaaggaatttgtcttggctgcacagtcactaaggagagagcagcacccaactgtgccattccctgtcctcttgggagctatactctctgtatccctgcttctgttcaacgtatctg

SEQ ID NO: 16223 - DNA, 278 bp, Homo sapiens
gaaaagagttctgataagtattggggagaatttcaagaggaacacgctgggaaccagacgatggggaagaattaataaggtgggtaggatcaaactaacagcactaacaaggacatacggtatacgtaaagggaatccaatatctctgttacacgaagaaatatctaaacactaatttgagaaaaaaagtttagtctaccaactgtgaatacgagatagggagggagaatctgcggtctgaaggtgaatctgaagtagaaaagagaagccaggctccc

SEQ ID NO: 16224 - DNA, 256 bp, Homo sapiens
tgtagaggtgaataaattcaataatcaatgcaatagtgatcaggaaagagaccaataccaaaaaagtgtgatcaacagaaaacaataacaacaaataagacaactgaaatgagtccaaatatatatttaatcacattaaaagtaaatgaactaaattcttcagcttaaaaagaaagacctccagattgcataaaacccgtaatccaggtatatgctgtctacaagcatcagacctaaaaatagtaactcaaaaaaa

SEQ ID NO: 16225 - DNA, 299 bp, Homo sapiens
taaagtgagtatactgtggagaggacttccaaacgcggatacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagt

SEQ ID NO: 16226 - DNA, 414 bp, Homo sapiens
gatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattaggtttagacaaaaatggtccatcaattcagacactctgcttggatgccttacccttttcattagtgcattctttgcttctgaaact

SEQ ID NO: 16227 - DNA, 290 bp, Homo sapiens
aatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggaaggataaggacataacagaagcaatagagactaccattagtcttgaaacagcacgtgcagaccatccgaagcctgt

SEQ ID NO: 16228 - DNA, 428 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggat

SEQ ID NO: 16229 - DNA, 201 bp, Homo sapiens
ataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgagcaaaaaaaaaaaaaaaaaa

SEQ ID NO: 16230 - DNA, 365 bp, Homo sapiens
ctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaaactaccgaatccaaaataacagctacaaccacacaagtaacatctaccacaactcaagataccacaccattcaaaattactactcttaaaacaactactcttgcacccaaagtaactac

SEQ ID NO: 16231 - DNA, 482 bp, Homo sapiens
atgagaaaggaataacaggtgataataaggtaaccttggataaagataagatatgcctaattatgtctgggtttgttttcagtttcatttttaaaaatcatggtcttatttgtattgtatttaatatctagcaggtgagtgttttctttggtttactaacaaccttgcaaggaaatagttaaatcattttaaaacacttcaagctcttaaaatctgatgatgacaatatttttatcagtctgataagttttacatccttaatataagtctaattaaagttggaaataagatttttatcctttcttacttataggctatgattttcataaggtttttccttttgctctttttgaaagtttcagtaggctggacgcggtggctcacacctgtaatcctagcactttgggaggccaaggtgggcggatcacaaggtcaggagttcaagacagcctggccaatatggtgaaaccccatctctacca

SEQ ID NO: 16232 - DNA, 505 bp, Homo sapiens
aaggaaacaaaagccttgaggaatgaaggaaattgccaaaagaccattaacaataataaatgactaagccctctgttccacagtctgcacttttctttctgcggaatgacccttgtaattgtaagccagggcatttctccacagatggatatcccataaaaacaaagccaaagtgacctgaaaggcacagagaaaatgtatgtctatgtccatttcttccttctcaatggttcctttttattcgtttgaaaataagagtgtgaagatgtgattctaatgactaataacaactaaaacatttattaagtgctgattatttgccagctcttttgttgagggtttatatggatcctctcatgtattcctcataataaacctgtaaggcaaatactatgattatccccatttcacagataaggaaatatctacagaggagtatttgacttgatttgggccccataactaataggcagagcactggcttttaaactcaatttgacacaat

SEQ ID NO: 16233 - DNA, 545 bp, Homo sapiens
gaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaaga

SEQ ID NO: 16234 - DNA, 353 bp, Homo sapiens
tgcttttggcgcgaaagatgccgggtctgggtgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtagaaaaaaaa

SEQ ID NO: 16235 - DNA, 626 bp, Homo sapiens
ttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatataatatgtcaata

SEQ ID NO: 16236 - DNA, 253 bp, Homo sapiens
tggaaggcattgataatccaaataatatataaacacatatggaaaatccttgctcagctctaatctccttacatagcgtttcccaccctatactcaattctttttactaatttcttgtgaattctttttttgtttttatagcaaatgcaagaaagttaaggtatattcttttatccccttgcctttctcttacaaaatacaattgtggtaaaacacatgtaacaaaatttagcattctaaccattattaaggg

SEQ ID NO: 16237 - DNA, 407 bp, Homo sapiens
agatacttacatagtttgtggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggccgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgaaaaaaaa

SEQ ID NO: 16238 - DNA, 237 bp, Homo sapiens
ataagaagctgaggtcatgcttgaatacttttcagccaatattttatagcctttcccttaaatcaagattgagtttaaaattatagtttgtcttttggcttaacagttctgaatgctgtcctcaaagtatataatgtttcatgtaccaagacccttttcacagtacaataaacagatctattcataaatttttgttattttataaataaatgattacataattttagaaaaaaaaaa

SEQ ID NO: 16239 - DNA, 176 bp, Homo sapiens
aatttgaaatctggttaggctggtgttagggttctttgtttttggggtttggcagagatgtgtttaagtgctgtagccagaagcggggggagggggggtttggtggaaattttttgttatgatgtctgtgtggaaagcggctgtgcagacattcaattgttattattatgtcaaat

SEQ ID NO: 16240 - DNA, 168 bp, Homo sapiens
attattatattgggacccccttcaaacctaaaaatcaagttatttccttttataatacttttcttccccatggaacaaatgggatcaatttgtgagttttttcctttaatgataactaaaatccctctaatttctcatttgaaaaaaaaaaaaaaaaaaaaaaaaaaa

SEQ ID NO: 16241 - DNA, 390 bp, Homo sapiens
actgtaataattagtgtagtcatttagtcagaagacatttaagcagtaatattccagaaataatattgatgtaattaaactgcaagacatttagttttttccccaaaataccatcttattttaatttataattgaatcaggtaataatagtaggcattatcagtagatttaatatctaaaaggacttaatataactaatattatgttaagaaaaaagttacagaaaagtttgatgctaattctataggaaaaactactatgtacaagaagaatattgaagtataccaaaatgatcattatgattataggtaatctcctttacaattattattttgtctattttcatgcatttcctgcatttataatgagtatttattgctaaaaaaaaaa

SEQ ID NO: 16242 - DNA, 416 bp, Homo sapiens
gatgaggatgaagaaagattgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaat

SEQ ID NO: 16243 - DNA, 535 bp, Homo sapiens
ggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatcttttttggtaccttcagatgt

SEQ ID NO: 16244 - DNA, 554 bp, Homo sapiens
tcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgcttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttt

SEQ ID NO: 16245 - DNA, 519 bp, Homo sapiens
atacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgccagttaacagatcattgcttcataagtttttaaattattttaatttaatattctttagtagaaatagtccacaaaaacattttcttgaatttaaatatacaacttttatatcatgtatcaaaccagatttatattcaaacgatcacattttaaattctgtacataacagtaagcgcactagtcaaaagacatttatgtttgaaatgtcatttagatcaaacacaagggtcaaagc

SEQ ID NO: 16246 - DNA, 526 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaaggtaaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagccta

SEQ ID NO: 16247 - DNA, 310 bp, Homo sapiens
gtggaccccgcagacaagcaggtttctctttgaatgatagagactaatacagctacctaaaaaccctagccaataggggtactaaagatattgcctagccgttaagtctttaaccgaaattttaaatagcttaagattttaagagaaaacatgaagactcagaagaggaggccatgcggaaggaaaagataaaagggttctaaaacatgacggaggttgagacgaagcctcttcatgggggaaaaaatggatttaaaagaaaattgagagaagggccctacagagccccgaataataccaatagaagggc

SEQ ID NO: 16248 - DNA, 571 bp, Homo sapiens
cagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcat

SEQ ID NO: 16249 - DNA, 355 bp, Homo sapiens
agaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttccgggcagaccttatccaaagtctggtacaactgtccttagactgatgagcaaaggaggagtcaactaatgaagaaatgaataataaattttgacactgaaaaacattttattaataaagaatattggc

SEQ ID NO: 16250 - DNA, 553 bp, Homo sapiens
agtggaggagattcaggagacttgatttatggaagctttttcttatttgcaattcagcaagaataaccatatgaaagaccatttgtagaaaagtgcaaattgctactgaaaatgatattgaaagaaaatgagacctgtttctccttgttgaaattgagtgtggatagaaggagagacagccatcgtgggtcagagggagcctcccaggcttcctggatgcaggctcccgtctccagaccccttccttcttgaccgaggggagaggacactgaaatgatgcacatattggtgctgctaatgtgaaagatgcagaaaccgttatccttttgaatttccagtggaagatccaacgaccctttgaacagctgccaccatggtggctgtggcttcattttgaggaaaacatttttaatatcttgtggccgtgcttatggcctgaaaagcagcattaacgagttttgaaactattattattcattttaggccagtccgtattttttctattgcccttcccgtgatcacttatgcatataaatatcattatgcttttgct

SEQ ID NO: 16251 - DNA, 235 bp, Homo sapiens
aaaatcaacattatacttagcaatatgataatagcacagatttcttaagttcaagatacaaaattactacttttagtcatttatatagttgttgaaatttggcagtacaatatgacaaggattaggaaatgatcataaatattgggaaaggaggaatcaaaattattctttccaggttatataatatactgtcgtgcaaaccttaaggcagctggggttaaccacctggacactt

SEQ ID NO: 16252 - DNA, 266 bp, Homo sapiens
ggagtggtgcctcgcatgctgataacaattctgggcacggtgaagcccaatgcaaacagaattgctttagatttccaaagagggaatgatgttccctgccactttatcccaccgcttaaatgagaccaacaggagagtcatctttttgcaatacaaaggctggataatacctggggaatggaaggaagcaagtggtttgccccatttgaaaggtgggaacccccctaaaactcaaaggcttggtggacccccccccctcaagggtk

SEQ ID NO: 16253 - DNA, 216 bp, Homo sapiens
tcaacttagtaaagaaatcaatggaaaatcggctccatgggaaaaaacaacatatcagagcactgttgattgatagagtaatattacagcatgagctacggacactaactgttgaggggttgtgactacagaaaagagtacatcaagatatgatcagagatcttcttcgtttatctacaagattcaatacagtcaggtgagaaataaggctcagca

SEQ ID NO: 16254 - DNA, 206 bp, Homo sapiens
ctgaaactcagcttcttctcacttgtcggataatcctagaaactcacaaaatgtgtgatgcttttgtaggtacctagaaacttgtctccagtgaaaactttgatgattatatgacagacgtaggggtgggctttgccaccaggaaagtggctggcatggccaaacctaacatgatcatcagtgttgaatcgggggtgtgatcaccm

SEQ ID NO: 16255 - DNA, 159 bp, Homo sapiens
tggtctgctttctacattcatggtatggaaaccatgtgattctttgtacagtttatctgatgttgcttgtaatgcagtagaggctatttcggcttcggcttttcttttctcgacctttttgttaaccctattacttgtggagcgcgtttcctttaggaa

SEQ ID NO: 16256 - DNA, 173 bp, Homo sapiens
agtatatttataaacaggaacctgtacagaagtgccctggaagaagggcctgctctaaattatccagtgtatagagacacgacacaggtaggagacgtcgctctgaaccgtgctataggaacctctcaaacacacacacatcaagattccatattcacacctcccagcttggs

SEQ ID NO: 16257 - DNA, 223 bp, Homo sapiens
agattgaaaacaaaataaaacttgtcctttatttcagagagtttgagaattgatctagaaaaacgattctcaaactatgtccttggccggcagtatcggcatcaacttggaacttggtagcaatgcaggtctcatccctacccagagtctctctgcaatagagaattctcgagctaggggccccacaaatctcgtatttttgacactctctcacagggagtct

SEQ ID NO: 16258 - DNA, 161 bp, Homo sapiens
agtccttatgtgataaactaagaagcccattgaatataaaagtgtataggactgaaacagtgaccttatattattgctaagggaatatgagattaacttcctacaggggccaaaaccagagaaaggctttcagcaacttcgatgaaagtaggttggccaca

SEQ ID NO: 16259 - DNA, 167 bp, Homo sapiens
attttaacaaagtgtaccatgtagcatgttttgtgtatataaaagggagggtttttttaaaaatatattcccagattatacttgtagtgacacgaatctgcaataaaagccatcagtgctatttggatgtatctgcaaaaaaaaaaaaaaaaaaaaaaaaaaaaaaa

SEQ ID NO: 16260 - DNA, 249 bp, Homo sapiens
gagcggcaggcagcgatggcgattttgagtgtgtatgtggtgaacaaagctggcggcttgattacagttggacagctacgcgacacgggctgaggcttgagaaaactttcagttattccgctggatcttcttctcaagctccacgatgagcgtgtgtttgatgctttcggcctgcgggacggcatccgagggatcaagtttgttggtctagcagatcctaaggcaagcttggaatagagtctcttctcc

SEQ ID NO: 16261 - DNA, 166 bp, Homo sapiens
aacctctgtattactggcaacagactgaagatgatttgacagtaaccatacggctttcaggaagacagtactgagggagacattcaaattacaggtttttggcctatacacaacaacaaatgtgactgtgaggggacaacccagtttgtaggaaggacaactctcm

SEQ ID NO: 16262 - DNA, 122 bp, Homo sapiens
  misc_feature 20: n = A,T,C or G
ttcaggagctgcgtgccatnagaatgagatcaccaaagtgcgaaaagttactttcatggactgaccagatgaattgtcctagacctcgggaacaattccctgaaggggccaaggattgaaaa

SEQ ID NO: 16263 - DNA, 124 bp, Homo sapiens
  misc_feature 24: n = A,T,C or G
cttcgctagtctccgtatggcctntgccaacgcccggctcttcggcatacgggcaaaagagccagggagcgcagaacaggatgttgaaaaggaaaaataaagtccttcatgggacttgggatca

SEQ ID NO: 16264 - DNA, 156 bp, Homo sapiens
  misc_feature 29: n = A,T,C or G
agatatcgaagtcagttattggtctcccnagtgcagctctgggagccttttgaagaatcagcactcattaagagctgagaagagagaagacctgatttggtgggttgactagcagtcacagaacctgtcctcccaggctgttcctgaggcctgacc

SEQ ID NO: 16265 - DNA, 149 bp, Homo sapiens
tgacttctctggcaccctgtaacagcatcactccttaagccaatcgtatttttctcagaatgaaggtgcaaaatttaaatcatgcatgcaaagcagttcgtaggtgctccatagtatgtggttagccttatattgcttacttaggatcc

SEQ ID NO: 16266 - DNA, 203 bp, Homo sapiens
  misc_feature 19: n = A,T,C or G
ttgatccttctatactatnattgctctataggggacaagtgttctgtttctttatgtcactgttatgtggagtgagatataaggctctttgatgtataacatactcaaaagctgttacactttctctgatctgctgtgatccccttaaaatgttcctggggtttgttctgctgtccactgttttttgctgctggaccttggcc

SEQ ID NO: 16267 - DNA, 150 bp, Homo sapiens
  misc_feature 24: n = A,T,C or G
tattctacacttcatggaattatnacagcagattaatccctctttttgtgacacaagtacatctaaagttatattggaaaaccatggaaatattaagcgttgcacacttttacctagctaaaaccatcatcacaaaggctttatcgtatt

SEQ ID NO: 16268 - DNA, 232 bp, Homo sapiens
aagcatttgcgtttggatggcaatcgcatctcagaaccagtcttccaccggatatgtatgaatgtctacgtgttgctaacgaagtcactcttaattgatatctgtatcctggaacaatattttatggttatgttttttctgtgtgtcagttttcatagtatccatatttgattactgtgtatgacttccatgaattttaagatctgaggggagatgttttgtaaacatatat

SEQ ID NO: 16269 - DNA, 262 bp, Homo sapiens
gaggcctgagctgatgggtcaatgaaggtgattcaggctgaggaatagcaattcacctacacagttctggaggatggttgcacgaaacacactgggggaattggagcaaaacagtctttgaattatcgaccacgcaaggctgtgagacttcctattgtaggatattgcaccctatgacattggtggtcctgatcaggaatttggtgtggacgttggccctttttgctttttataaaccaaactatatctatatcacacaaaa

SEQ ID NO: 16270 - DNA, 233 bp, Homo sapiens
tgttttctaattatgaaacagtacacagagggacatctgtgtcaatatggctcagcatataagagccaattttgctgtatgcttttaaactactctataggcaaccataccaatattatattgtggggagctaactgaaaacagtttattagggcatttattgaaatgtcaatggtgcgtaaaactgtaatccagtaccttggggtaccaaggcagttggtacaggattgggg

SEQ ID NO: 16271 - DNA, 270 bp, Homo sapiens
tgctcagtaagcacttgcagccgtctgttatgctgtgacacatggcccctccccctgccaggagcttttgactatccagcatccctttgcccaggaaggaggatggggaggaggcaataattaaagagttggaggattttgcttggataaggtcaaattcttctgaactcaaactgagggatttcaccctaaactgagtcgacagagagctgtcctcgcatattcacaagcgtttatatctcctgctctcatagtgatgctgccctggga

SEQ ID NO: 16272 - DNA, 255 bp, Homo sapiens
ccctcttgaccgaaatttcttgtgacacagagaagggcaaaggtcttgagcccagagttgacgggagggagtatttcaaggttcaattcaggggcttccaaaagcgcacaagatcgtttaggggagagagagcccaaggttggggacttgggaatttacaagagagcttgggaacggatccccttagggtcaaggaagctttttttgcaaactctcgaggatatgcttttgccccaagagttgctcttctccccc

SEQ ID NO: 16273 - DNA, 110 bp, Homo sapiens
ttgtaataagcaacttgataatttgagaataacttgacttgttgcaactatgattatcaattgtaaatttacccttgacatatagtgtacaatgggcactgtatgcatta

SEQ ID NO: 16274 - DNA, 175 bp, Homo sapiens
caaaaatagaagtattcttcagatacaacctgttaaattccaatcttattcattatttaacactttaatacaattatttggcttggcacagtggcgtctctgcctgttatatctcagcacttttgagagggtcgagaggtggcagagtcacacttatgtccaagagagttgagag

SEQ ID NO: 16275 - DNA, 180 bp, Homo sapiens
tctaaactggagtgatgttagcagaccagcttagagttcttctttctttcttaaggcctttgctcttagaggaaggtcttcaagttcaacttcaactcacaagcttcttcacaggaataccctctgggagtgttccctaggggttttctcatataattaggggtttcacattgtcccctt

SEQ ID NO: 16276 - DNA, 150 bp, Homo sapiens
gctgcatktsaatagcattggtaggtaatgttctaaagcgtgtatttgtgttattgccgataccttgtatctctcctgagggaagcatcaggtgtgacagagagattctctcctcacacagagttttacagatctctgggagacacagtg

SEQ ID NO: 16277 - DNA, 158 bp, Homo sapiens
gatctactatgttacagaagtcagagagctgacagatctgttgactgaattgcagaaaacgcttgatgattcatattctgcaggcagtaagaccagaactgtaggagcctaacattttgtttgacgggcacacagtttaaattgagacacactataca

SEQ ID NO: 16278 - DNA, 180 bp, Homo sapiens
cgggtgatgttcgttgcacttctagacacgatcaattcccattgacgtcctgcaggaactgcatgctgcaggtgtactgcccttccgcccacgagtgcgccatgtttcagcggaggaccgttttgggagaggccacgctcgtgttttcacaatgttcggggatcggattgccttttttaa

SEQ ID NO: 16279 - DNA, 102 bp, Homo sapiens
  misc_feature 30: n = A,T,C or G
aggattgctttaactttggaggctgagatncagtgagccaagatcgtgccatagcactccagcctcggtgacagagcaagacctgtctcaaaaaggcaaaaa

SEQ ID NO: 16280 - DNA, 138 bp, Homo sapiens
tcagagttcagtctacagatgctccacctgagtttgatatgctgattgtgggtgtgtgtgttttcagcaaattcagatttggttccttttggctccttaaagggtccaggagggcattttccaatctttccaacttct

SEQ ID NO: 16281 - DNA, 156 bp, Homo sapiens
  misc_feature 30: n = A,T,C or G
gacagataatatacgtactgcatgtcctancagtacaacaggtgcagtgtcagtgtctacaggggtatcatgggtattggccagcaggtgcattcaggggagggcttagagagccttcgagggcagtagggtttttttggccgagggcttgcctat

SEQ ID NO: 16282 - DNA, 166 bp, Homo sapiens
cacatgtgtatggtagggcaataaataggaggtaggatgggccatttgtctctgtaaacagtaaagcaaattggagtaatgtatttctactgtacggtaggtagggggacaacatagggccccgcccccccagtaggggggggggtgacaaaatgtatgtctccag

SEQ ID NO: 16283 - DNA, 121 bp, Homo sapiens
gatctataattagtcattaatagatgtaatatttaactgactttagggatataacgcaaactattttatctcataactcagacacagttttcaacatttctagagagacattttcctccct

SEQ ID NO: 16284 - DNA, 171 bp, Homo sapiens
  misc_feature 30: n = A,T,C or G
cacaataatgacacaacttatcaaaacctntgggatacagcaaaggtggtgctaagaggaaagttcatagccctaaatgcctacatcaaaaaagactgaaagaggcaaaaaaaggacaattctacaagtcacaacctcaaggggttcttggaaacaaaggaccaaacccaa

SEQ ID NO: 16285 - DNA, 261 bp, Homo sapiens
cattgtgagactgatgcacaaactgtcacttggttaatttaagcacttctgttttcgtgaatttgcttgtttgtctcttcatgcctttacttactttgtcccatgctactgattggcacgtggcccccacagtggcacagtaaagcccctttgtgaaactgttctttaaatgatgcacaaggagattggccactggtaaaactctgcagcttcaactgtacttcatttaatgccattgttgcaagtatacttctcttcttt

SEQ ID NO: 16286 - DNA, 205 bp, Homo sapiens
ggaattgtttttgaagattcttttttcccatagtgctggtttatttagcactgaaggtcatctgctaacccagctttcagcagcctccaggaaaacctcagtgtagcttgttgtcatgtattaacagtcccccaatttcacttatattttgctaagcagatacacatttgccatgacagctttaagggtcggggcttttgaattg

SEQ ID NO: 16287 - DNA, 196 bp, Homo sapiens
aaccttaataagccttaaaatcaagtagtctaaattttcctacttgaattccttttaaaattttctttggcagccgggtgcagttgcttccggcttttaattcccaggcacttttgggagggccaagggcggggcagatcaccggtttttcaagagagtgcaagagccattccttgcttacacacggttaaacccc

SEQ ID NO: 16288 - DNA, 183 bp, Homo sapiens
aaatgtaaccctttaaggagcctggcttcactgtcttcaaaattccaaatggaaaaccaaaagaagatgaagcttaatgttttgactcacagagatgtttgggggctacctgagtaatagttttgaaattgggtgtttctcttaattgtaggattttaattaaacccctacttgtggaggggt

SEQ ID NO: 16289 - DNA, 180 bp, Homo sapiens
agcggttattcggtgagcggtggtggtttattcttccgtggagttaagggctccgtggacatctcaggtcttcagggtcttgcatctcgaactatataaagttcagaaaacatgtctcgaagatattactccaggaccacttatattttctccagaaggtcgcttataacaaggtgaata

SEQ ID NO: 16290 - DNA, 225 bp, Homo sapiens
gcaagggaaagggggatagaattgcatattgcaaccatttcagctggctgaggtttccagaacacttactatgtgaatgagacattattataatttaaattgctaagtgtgattttaaaagatcagttataacatgcctgttttttgaaacttatgtatattttcgggtgagggtttaaggtcttcagaaataattttttatatctcatggctatatgtttagga

SEQ ID NO: 16291 - DNA, 150 bp, Homo sapiens
gagtgaagctcttcctggggacaatgtgggcttcaatgtcaagaatgtgtctgtcaaggatgttcgtcgtggcacgttgctggtgacagcaaaaattgacccaccaatgggaaggagcttggcttcaactttttcagggtgattattccy

SEQ ID NO: 16292 - DNA, 160 bp, Homo sapiens
ttatgtcttccctctttccaaagagctgagacagaagtacaacgtgcgatccatgcccatccgaaaggatgatgaagttcaggttgtacgttggacaactattaaagggtcaagcaaatttggcaaagtaaggtccagggttttacaaggaaggaaatat

SEQ ID NO: 16293 - DNA, 209 bp, Homo sapiens
tgcagaggaccattgtcatccgccgagactatctgcactacatccgcaagtacaaccgcttcgagaagcgccacagaacatgtctgtacacctgtccccctgcttcagggacggtcaggatcggtgacaacgtcacagttggcgagtgccggcctctgagcaagacaatgcggttcaacggtctcaaggtcaccaaggctgccggcacc

SEQ ID NO: 16294 - DNA, 183 bp, Homo sapiens
cactaagaaattgtgacattttcttcccagaattacttcgttttatacatttcacttctcttctgaaatcacagcaatgccagtttgcggccttttggtctgaggaacgcaggccctggccacttaccatggaaaagtatttacttttaaaacttgaatgtatatccttacccaatggctaga

SEQ ID NO: 16295 - DNA, 129 bp, Homo sapiens
gtttgcagaggcaactgccaatagcgtcaactgcttcgccaacgtgcgtgcgagacgcgttgtctcaagtctgcgggcttacggactttttgccgccgtctgggaggatctctcgtacgaaccttacgg

SEQ ID NO: 16296 - DNA, 248 bp, Homo sapiens
agaagtgtatggagagctatctatggtgcaataactgtggaaatacagtttttattctatttggttcccatatacattgagtcctcctttggtgggaatttgatcaggttggtctcagttgaatcctggctgcatatgcctcagtaaggaagaaggcctaggggactttggaaagcctggtggtggtccttgaggcttgagaatacctggagctggaagctccttgcctcattgggtgaccctttttc

SEQ ID NO: 16297 - DNA, 200 bp, Homo sapiens
ccaaaataagcattctaatcagatggagaaaagcattgaacacgttttgttcataagtgtttgcctcagagaagatcttgagaaattttggagaaaataattatattgggttcttccatctgtttcttgttggcttttccaaaaatttctaaaacaattaggcattctttttataattaggaccacaaaccattattttc

SEQ ID NO: 16298 - DNA, 160 bp, Homo sapiens
aatttcttacttatctgacatcatagaagattgctaatttgaattgtctcatgaattttcaatttttgcctttctgaaacagacaatataaactgaaataagatctattacaaagggtaactttttcctaggtctgttcaagggattcctaaggtgcaca

SEQ ID NO: 16299 - DNA, 202 bp, Homo sapiens
cgaatgtttaatgtgcttccactgttgttcgagcagtagtgtttgtattgaaatcgtgcctgttcacatcccacactgcttgtgttgggtggaaaccacttggggagatgctgcttgatatacagatcccgctccatctgtgcatttgaaattcataggcatcttggggacagtggcatagaaggcagttggccacaggaaa

SEQ ID NO: 16300 - DNA, 218 bp, Homo sapiens
atgaatcacatgaaagcatggaatcttatgaacttaatcccttcattaacaggagaaatgcaaataccttcatatcccctcagcagagatggagagctaaagtccaagagaggatcccagaacgctctaagcctgtccacgagctcaatagggaagccgtttgattgactgcaagctttgctgaccgttacggccattggcttattgggagacaatts

SEQ ID NO: 16301 - DNA, 249 bp, Homo sapiens
tgaataagtgttgtttattattaaaacaataatttgttaatttcttataaggtcctgtgctataattactggtataaatataactgactattggggtagctttcatttcttccattaattacatgtgtaaaattaaaacactactgtaatgttaatttcccggttttgaaaatattttatgggtatgtaccatgttaccatcagggcagcttggcagagggtttcacatagtctctatactcttttgga

SEQ ID NO: 16302 - DNA, 260 bp, Homo sapiens
ggactaacccctataccttctgcataatgaattaactagaaataactttgcaaggagagccaaagccaagacccccgaaaccagacgagctacctaagaacagctaaaagagcacacccgtctatgtagcaaaatagttggaagatttataggtagaggcaacaaacctaccgagccttgtgatagctggttgttcaagataggatcttaggttcaaccttaaaatttggccacacagaccctctctaatatcccgtgtw

SEQ ID NO: 16303 - DNA, 222 bp, Homo sapiens
taaacagctgctgtgaagaagaaaagttgaataagagttggcttaaattttaaaaaagaaaaagaaaattgaggttttaggattttcatggtaacaagctcttggtataagctaaggctggcaagttcagatactaaaatattatttgatcatatcttggattccttttgaaaaagttaagactatatgaaggtaaattaggaataagtagtgatatttath

SEQ ID NO: 16304 - DNA, 113 bp, Homo sapiens
tgattttttctcagcaattttcaaaacggtggggcttcttcatcctcttctttcaagctaggttctaatatgtgtcgtgtttcacacaaaaaaattgaaaccaagagggggtc

SEQ ID NO: 16305 - DNA, 181 bp, Homo sapiens
aacttcatttgcgaaaaagacagggagacagtacttgtcatctgcattataacggactgtgatgggatcacatgagcaaattttcagctctcaaaggcaaaggacactcctttctaattgcatcaccttctcatcagattgaaaaaaaaaagcactgaaaaccaattacttaaaaaaaatt

SEQ ID NO: 16306 - DNA, 155 bp, Homo sapiens
aacctactggattaattttatcaaatatcagacttactgatctcttggcagagatttattggtgtctcagtgtgatcacaatacaagttgtagcaacccattttataaaactctttagagaattatgtagataaaatggggattacataawccyc

SEQ ID NO: 16307 - DNA, 243 bp, Homo sapiens
aattattacatctttattaacctcagcatttactttgattcttttgcttaggaaattgctcataatctggttataattttggtccaaattctttattcttccttgagctaagcagaataatggaatataatatgtcttcataatataacagcactaatacactaatagtcagattaagttaggcagtcttctaccaaatgtgtaataggagattgcctcaaaaatgtgtccacataatacacg

SEQ ID NO: 16308 - DNA, 269 bp, Homo sapiens
taaagaagaaaggatacctaaacattcttctcaaaatagtaattcagtggatgaaagctctgaagactccttaagcaggctttcttgcaaacccggtgttgatgattcatggcctacctcagatgacggagacctcaattttgatactaaggatgtcccataaccaagcttagcaaagctaatgactgcttctcagcaatccagggaaatttagaagcaacatatggcactgtgagaacaggaaatagagctatgtttgaggatagaga

SEQ ID NO: 16309 - DNA, 165 bp, Homo sapiens
agctggaagatggacgtactttgtctgactacaatattcaaaaggagtctactcttcatcttgtgttgagacttcggtgggtggtgctaaggaaaaggcaggaaggaagtcttacaccacttccaaggaggattagcacaagagaaagaaggttaagcttgctgt

SEQ ID NO: 16310 - DNA, 157 bp, Homo sapiens
caaagctggatggagaatgactttgacgagttgagacaagaaggcttcagacgatcaaacttctccgagctaaagaaggaagttcgaaccccattgcaaaagaaggtcaaaacccttgaaaaaagattaggacgaattggctacctagaattaccca

SEQ ID NO: 16311 - DNA, 174 bp, Homo sapiens
atccaagaaaatttgttttgctggtaacttttaaagaatgaatatatttttaatattgggaaacacccatgttctctaaataaaatatagccatggcagaaatgcaatccttttttttataaaagtcttttttttcacctattgatgctttgttgcaaaagtgtataaaggata

SEQ ID NO: 16312 - DNA, 209 bp, Homo sapiens
gaccgctgtcaatcttgcctggacagcaggaaacagtaacacgcgcttcggaatagcagccaagtatcagattgaccctgacggctgcttctcggctaaagtgaacaactccagcctgataggtttaggatacactcagactctaaagccaggtattaaactgacactcgtcagctctctctggatggcaagaacgtcaatactggtgg

SEQ ID NO: 16313 - DNA, 217 bp, Homo sapiens
tgaagtggaaaactggaagacagaagtacgggaaggcgaagaaaagaatagagaagatagggaaattagaagataaaaacatacttttagaagaaaaaagataaatttcaacctgaaaagtaggaagcagaagaaaaaagacaagctaggaaacaaaaaagctaagggcaaaatttacaaacttagagagagaatttgagagatagagacacagaga

SEQ ID NO: 16314 - DNA, 143 bp, Homo sapiens
tggtgcttgggagcacttttaatgggcaggcatatttacaaaaaaaattcctttaccgggtcctaaaaagctaccaaaaaaagttgtcaagccttccaggtccctgactcccgcaaagggtgggcgttcaagcaaataatttt

SEQ ID NO: 16315 - DNA, 410 bp, Homo sapiens
  misc_feature 389: n = A,T,C or G
tgtttactaggtagcagtgcttgggtttacaaaaataaatatgatccagccaggcgcagttgctcatggcttgtaatcccagacttttggggaggtccaaggcagggtggatcacttgagggcagggggttcaaggccaggcttgtccaacatgggggaaaccccgctctctgtctaaaaagtataaacgcgagggtgggatggggggaatgtgctgtaatcccagctactttgggggggctggggcacaagagttggctttaagccccsttggggggagggtgcggggggtagtggtcgagcactctactcccgctcgggggcacgagggcgcggcctctcaaaaaagtattatatagggtgcgtgctcccacgcgtgggtgtttctntcctcggcggcgcgttgattt

SEQ ID NO: 16316 - DNA, 243 bp, Homo sapiens
tacttactcagaattttccaaaacttataaagtacattagccaacagattcaagaagctctctgactctaaggctgaataaaaattaaaccacttttaggaaaaacctcttacctttagctgaacacaaaataaaaccaccttcctgcacaaaccacaacaacacaaatctttacagagagcgacacgtatatactctttttctttctcagcgcaaaaatgatgcacaccccaagacacacwt

SEQ ID NO: 16317 - DNA, 333 bp, Homo sapiens
  misc_feature 312: n = A,T,C or G
cttacttttactactacttaattgagcctatttataaatgggccattaaggtaatattgattaatcctgtgttggtggcagaataattaattgtgtggaaaaggctcacattgcaccacataaaataactccatgttcacaataggagtgtctagaaatagtaccctacacaggggtttgagagagtcttttctagagtatcatcacatgtgcacacgggtcgtggaggaggtgatgagcgcagcacagaccaccagcagcttctttgttttttatgagaagaaagagggtcatcacggctactctgtcganctctctcccccagatcattcg

SEQ ID NO: 16318 - DNA, 222 bp, Homo sapiens
atagtgcatctgctttcagaattaaccggaagcagtgtccagacagtaagggttcaccccatttggccaaacatgggggtcttaggtgcaattccttttttttccttggcctttggtttggtggaccccgtttggccggatacttgggattggggcgttcccccttttcccttttttgggcaatttatttacccacactctgtccaccccgggtgggcgcgc

SEQ ID NO: 16319 - DNA, 262 bp, Homo sapiens
ttctttaaaagaggtaagagcaacgtgcttttggagcagagaagagggagaaagcagcaaactttccttgattagccaaggggacaaaaaaagagaaggccaatttttttaatttttattaccctggaaaaattttgttaatgtgcatttgctaaaaaataaaatatacagctatgggacctcggagaccccactctcactttggagagtttttccccccatagtctctttttagggtataggcggccatattccacccgtt

SEQ ID NO: 16320 - DNA, 162 bp, Homo sapiens
acatttcaacattttaccatatttgcttcagatctcacttaagtgaaatatttggttcaggtcctactttgattcaatttccccttctttccaccccacaaggttatggttatgggttggcgggtttaatgccaattgcaatatgtgtgtcaaatttgtgcb

SEQ ID NO: 16321 - DNA, 152 bp, Homo sapiens
actttagaggcttcttgatttgcataaagttctaaggatatagatttccccccttttcgctgtatagcaaaggggttttaatccacgggttgtggcctaattttttccattaaaaaagggtctttcatacaaaaataaatacttttcgttta

SEQ ID NO: 16322 - DNA, 116 bp, Homo sapiens
acctccctgcctctaaaataaaactctcagaacctcttgctttctaacccaatttaagggtttctctccataaaaggtttacccccagggtatatttataaatcgggggggcgata

SEQ ID NO: 16323 - DNA, 145 bp, Homo sapiens
cacatttacttaaaacggatgatcatagctgaaacattatgatactgtcaatttgagatagcagaagtttcacacatcaaagaaaaaggtttgcatatcattatactaatgcaaatgggtgggttaacccttgacaaggtaaaag

SEQ ID NO: 16324 - DNA, 250 bp, Homo sapiens
tggagaggctggagacactgtacagtttggcagaagtatattcagaaaaacggtgcaactttataaggatgcgaaatgggatatcaatttgttctccccacggaaaacagctaaactttcaacagggcggaaacctgggctgacttttcttcggagagcgggcccccatatacatgtggagaccccccccctcggctgggctatatattagacataaaaggggccacacccttttatttacaaaggactt

SEQ ID NO: 16325 - DNA, 286 bp, Homo sapiens
ttatctcacaacgaactggctgatagtggaatacctgggattctttcaatgtgtcatccctggttgagctggatctgtcctataacaagcttaagaacataccaactgtcaatgaaaacctgaaaactattaccctggaggttaattaacttgagaggtttgacataaaggggctttgtaagatcctggggcattatctaataaagataagaatttgggtttggagggaaatggtatatagaaaccagctttctccccgatatttttgtttgttagtagttttaat

SEQ ID NO: 16326 - DNA, 329 bp, Homo sapiens
tgtagaagagaagaagaaggaggttcctgctgtgccagaaacccttaagagaaagcgaaggaattttcgcagagctgaagatcaagcgcctgagaaagaagtttgcccaaaagattgcttcgaaaggcaaggaggaagcttatctattaacacgggcaaagcactatcacacaggcatatatggcagagtgtacagagactctaaaattcgcgattgcgcagggatcgcaaaaacaggctcgcaaccttctatgtacctcccagagcccaacaatttgcggtttttcatcagaagtcatgaggtatcatctacgaggtgtgcccacaaa

SEQ ID NO: 16327 - DNA, 101 bp, Homo sapiens
aaatgcacgataggttgccgtgaatcttcaatttgtaaaacacacaatacctgcgaagataataaagtgaaatgcataaaacacggtatacctttaaaaac

SEQ ID NO: 16328 - DNA, 244 bp, Homo sapiens
tttattttgtgagtaatgttgctttggtgtttcctgattttgaaggttgcaatcatggagatacagcagttattaggtgtggaaggacaataacccaaaatgtccccaagaatggctccaaggaaattcttttaaaaaaagttttgagagaaatagtcgtgaaccctgtaaaaccctagaggggtcttgtaaaatccccacttctcgtgtagagggatttgtaaagtgccccttctctttagag

SEQ ID NO: 16329 - DNA, 310 bp, Homo sapiens
tcaccttcgtgaataccaagacctgctcaatgttaagatggcccttgacattgagattgccacctacaggaagctgctggaaggcgaggagagcaggatttcttctgcctctttccaaacttttcctccctgaaccttcagggaaactaatcttgattcactccctcttgttgatacccactcaaaaaggacacttctttattaagacgggtgaaactagagatggacagggtatcaacgaaaacttttcatgcatcacgatgacctccaataaaaaattttacacactctgtgcagcagtatattttca

SEQ ID NO: 16330 - DNA, 629 bp, Homo sapiens
  misc_feature 285: n = A,T,C or G
accagtattctcagagataccatcagagaacaaacactaatgttaattgcccaattgagtgcttcatgcctttagatgtacaggctgacagagaagattcccgagagtaaatcatctttccaatccagaggaacaagcgtgtctctctgccaagatccatctaaactggagtgatgttagcagacccagcttagagttcttccttctttcttaagccctttgctctggaggaagttctccagcttcagctcaactcacagcttctccaagcatcaccctgggagnttcctgagggttttctcataaatgagggctgcacattgcctgttctgcttcgaagtattcaataccgctcagtattttaaatgaaggggattctaagatttgggttgggatcaataggaaagcatatgcagccaaccaagatgcaaatgttttgaaatgatatgaccaaaattttaagtaggaaagcacccaaacacttctgctttcacttaagtgtctggcccgcaatactgtaggacaagcatgaactggtactgggatattttaaaaatccccagactcctttttccaaatgatcctaggaattgcctagaaaatcttctcttacctgtatttatcaattt

SEQ ID NO: 16331 - DNA, 270 bp, Homo sapiens
aaatgttgaataatagggcagcagagaaaatgaaacaggaaagaaatgctggagggggttagcggtctttctcagctttactcattgactgtgtacaaaaaggaggtaactgaagttgaatgagcctcagggatgtaatagaatgctatggtttttacccaagaataacaatccaagaggttaaagagataaaatggaataaagttcatttgtagaaacattttaagtagaatttgtgaataacctagttagggattatgccagctaacg

SEQ ID NO: 16332 - DNA, 510 bp, Homo sapiens
acactagtggatccaaagaatttggcacgaggaattttaccataaaaacagtataattcttaggttcttatgtcagcctacaaaagtctgactatcctaccctgtctataaaatgtagaattattttacctaattgccatttagaacattttttcaaggacgaactttaatactgaaattctgagatatgactattagttcacagtttatgaattgggcattggtagggtgtatatgtgaatgtatggtatacaacttctagagaagataagctttaggataatattttcagcataacatgtccctaagcaagtatataacacttaatattagcactgtcgctacatgtaaggacatgttaagctcgaatatacttttgcttttcttcctttgaggtgtaagatcacatggcatcctttagctataaacatttatgctgccagaggagtttgagtaaaggatgaaataaataagcttattattaaaactcactgcattttacaaagatgt

SEQ ID NO: 16333 - DNA, 500 bp, Homo sapiens
taacaagagctcccacgctgaatgtgtatggggactgcattttgtgggtagtgtgtgtgttaacagcaaattccagatatgtatcctttgggcctcctgcaaagtctcgagaagaaaatttgccaatctttcctactttctatttttatgatgacaatcaaagccggctgagaaacactatttgagacgtttataaaccgattatgtgattgtccttaaagggtggtcgtgccaatattgcacaaaatggtcctatcgctgtgaagagggacagaggataaagtgatgtcatacatcaatatgtatatatgtatttctatatagactggggagaatactgccaaaacatttatgacaagctgtatcactgccttcgtttatattttttaaactgtgataatccccacaggcacattaactgttgcactatttgaatggccaaaatttatattttagaaataataaaaagaaagatccttacatgttcccaaaacaatggc

SEQ ID NO: 16334 - DNA, 181 bp, Homo sapiens
aggcggacttgaggaaaccgcagataagttttggctctttgaaagatagagattaatacaactacttaaaagatatagtcaataggttactaagatattgcttagcgttaagtttttaacgtaattttaatagcttaagattttaagagaaaatatgaagacttagaagagtagcatataa

SEQ ID NO: 16335 - DNA, 300 bp, Homo sapiens
tcttctttctttcttaagccctttgctctggaggaaggttctccagcttcagctcaactcacagcttctcccagcatcaccctggggagtttcccgagggtttgctcataaatgagggctgcacattgcctgttctgcttggaggtattcaatacccctcagtattttgcctgaggtgattctaagatttggtttgggatcactaggagagaatataaaggcacccccgatgcacatgttttgaaatgatatgaccacacttttggggaggagagtcacccccacactctgctctcactc

SEQ ID NO: 16336 - DNA, 215 bp, Homo sapiens
tatataaaatacatagaacaatagattaggaaatcaaaagatatctctggcctgcaatattttactgatgtgaacataagggttttcccactaaactaatttgtctacttccaggattaacttaaaaagggttcttaaaaccacccataatagggacttaggtttcacacacttactctagatattttgtacacaaatttcccattcccctgtgt

SEQ ID NO: 16337 - DNA, 303 bp, Homo sapiens
tacaaaaacagacacctggaccaatggaacagaatagatagctcataagtaaggttgtacacctacaccatctgattttcaacaaagctgacaaaaacaaggttttgaataggatgacccctgcaataaattgggctgagataattgggtagccataaacagaaggtttaaacttggagcccctttttttcaccacaatacaaaaataaatttaagggggagttttaagagtttcatagcaaaacccccagtgatataaatccctccggggaaaaccccgggagtaccactttggacgaaagg

SEQ ID NO: 16338 - DNA, 211 bp, Homo sapiens
accaaaaaccaaattaagaagcacaaagccgcttcaatggttggggcaaataattcccttaacgctaatgcgctgtgggaaaacgatccccctattgggggggatggggggtttcccttgggggaattttgttgatatagaccccgggggttttaacccttttagagggggggggggcctcccaaaaccctcttttcttgacggggggggt

SEQ ID NO: 16339 - DNA, 128 bp, Homo sapiens
gtgagagagggatatgcattgcagttcagcaagccggaattctgtgttgaacagatgtctgtctcctagtgtgtgactcacaccttgtggctgccttcagagcgccacctccagattcagattggggv

SEQ ID NO: 16340 - DNA, 213 bp, Homo sapiens
cagaaatggcgctcaccatgcttccagctaacaggtctagaaaaccagcttgcgaataacagtccccgtggccatacctgtgagggtgacgttagcattacccccaacctcattttagttgcctaagcattgcctggccttcctcttttagtcttttcctgttaagccaaagaaatgaaccattccaaggggtttggaagtgtaagttttttt

SEQ ID NO: 16341 - DNA, 227 bp, Homo sapiens
tgacagcattcgggccgagatgtctcgctccgtggccttagctgtgctcgcgctactctctctttctggcctggaggctatccagcgtactccaaagattcaggtttacttacgtcatccagcagggcatggcaagtcaaatttcctgaattgctatgggtctggggtgcatccatccggacattgagggtggctacctagggatggggagggattgaaaaggtggg

SEQ ID NO: 16342 - DNA, 146 bp, Homo sapiens
tagacagacgacacgtcacaaagagacaaaattatctggaagggagtcagcaacttctctcataagatccaggattaattgcaactctgaactttttcaagaaaatggaaaactttgtatggtagctcatgttgacgtggttcctg

SEQ ID NO: 16343 - DNA, 158 bp, Homo sapiens
gaactgaagctttaagtctcatccagcattctaatgccaggttgctgtagggtaactgttgaagtagatatattacctaggtctgctattccttagggcataacccctgcgggtaccaggtaattgaggtatgtaactatcggggaacttcccttccc

SEQ ID NO: 16344 - DNA, 175 bp, Homo sapiens
agttggaacgactttatctgtccaagaatcagctgaaggaattgccagaaacatgcccaaactcttcaggagctgcgtgcccatgagaatgagatcaccaaagtgcgaaaaggtactttcaatggacttaaccgaatgattttcataggacctgggaccaatctccctgtgaggg

SEQ ID NO: 16345 - DNA, 124 bp, Homo sapiens
ccctttgcccgcggggccctctcgctccccgggtccctcgccctgttggtcccccggggggccgctctttcggccctcgggtccccccttgttgggggggggttccccccctttcccccccctt

SEQ ID NO: 16346 - DNA, 127 bp, Homo sapiens
gtgtatgctttccaagcttgccagtctggttggctttgaacactgcccatcagctacagtcattactgttccccaatccacaactatcttggtaaggagggcttaggttcacagtggaaaagggctt

SEQ ID NO: 16347 - DNA, 119 bp, Homo sapiens
aatattataatgagtatggaacaatgtttggaaatgtttttcttggtgtaatttagtgcagatttttactcattttgttaaaaaacttgataatttgatccctccatctattaataatt

SEQ ID NO: 16348 - DNA, 155 bp, Homo sapiens
ttctcttgccgcgtgctggtgttggagggccctccctgcttcaggggacagctcgcagaaagaagaaggtggtacatagaacagccacagcttgattgacaaaaaagcttcagaggttcttttaaaaaaaactggcctgttgaataatttagctg

SEQ ID NO: 16349 - DNA, 220 bp, Homo sapiens
gaggcagcagcgagggcttgtgctagggtcaggccgagtttgaggaacccagataagttggggtcttgaagatagagataatacaactacttaaaaaatatagtcaataggtactaagatattgcttagccttaagttttaaccaatttaataagcttaagaatttaaagagaaaattataagacttagagagtacattaggaacggaaagataaacgtt

SEQ ID NO: 16350 - DNA, 200 bp, Homo sapiens
tgtagttgttttaaattaaaaatttacctctagctataggtgctactttttacttaccctcaatttggagattacatcatgcaggctgggtacagtggttcatgcctcttaaccccagttgctttaggaggccaaggcggggagaattgttaaagagccagagaattagagaacacaccgcggcacacaaacaagggtgt

SEQ ID NO: 16351 - DNA, 170 bp, Homo sapiens
ctagctttctattagctctagtaagatgaaatgcaagcatcccattcagtgagttaccctctaaatcaccacgatcaaagggacaagatcaaggacggaacaattaagtttaaaacgtgttagcgtagccacacccccaccgggagacagaagttattaacctctttgga

SEQ ID NO: 16352 - DNA, 123 bp, Homo sapiens
agagaaattggagatagaacaagatagaaatgaaaatattgtcaagagtttcagatagaaaatgaaaacagctaagacagtattggagaagtatagaagattagaaaaatataaagcccaaat

SEQ ID NO: 16353 - DNA, 123 bp, Homo sapiens
gggcgagtatgaacagcagggaatgctggactcctactaggctgtctatctagctaagatgattatgattcaagaggagtacacatggtattaaggctcttcttccttccaccttaaaaaatt

SEQ ID NO: 16354 - DNA, 160 bp, Homo sapiens
cagtattaagctataaatactcaaaagtggcctcgagttaaatagtcattgttatttcatctaagtcatgtaggttgatattttcaacatatcattggagaattaatcttctttattaaaatagggcattttcttctttctggcgaaagttgggagtaac

SEQ ID NO: 16355 - DNA, 115 bp, Homo sapiens
gtcaaacgtcaaatgtttgctttgttacctggaggactaaatgtagatgtctttagtatacttcgtatgttctcaatattcgtagataattttgtgaatctgtagatttagttty

SEQ ID NO: 16356 - DNA, 184 bp, Homo sapiens
aaaatttaatttgggaaacagaatgaaggaaagattattgccttggttgcttaacattatttgtaaccattattttctgcatcttgcatggtgcacattagattatctttgcatgtactccttacattgaaggccttattggccatttctatgtgttttgcaaagtggtttggcacattgccac

SEQ ID NO: 16357 - DNA, 289 bp, Homo sapiens
gtctgtcattgtctgcctttaaatccttcctctttctacctcctctattctctaaataatgatggggctaagttatacccaaggctcactttacaaaatatttcctcagtactttgcagacaacaccaaacaaaaatgccattttgaaacgggggtatttcccctttcagaatgtagctcctcagagcagggacaatgttttctgtatgttctattgtgcctagtacactgtaaatgctcaataaatattgatgatgggaggcagtcagtcttgatgataagggggaga

SEQ ID NO: 16358 - DNA, 231 bp, Homo sapiens
atgatgatgatcatgacatatgtatttttccatctggaattgtccatgaggaaaatatccctataggggcatcttgaaaggcttatgattccaatattcggaaatatgacaattgcaggtagagagaaggtaaaattttctcaaattcacacaaaatgggggaggtaaggccaagggtgggaccctactcattggggcatagatctcatgcaaaatacaatgtcaagcttg

SEQ ID NO: 16359 - DNA, 169 bp, Homo sapiens
aaccattgaggagcatcctgcatcttttgactggagctcttttaagccaatgggatttgaagtatcatttctgaagtttcttgaggagtctgcagtgaagcagaagaaaaatactgacaaagaccatccgaatactggatacaaaaaaggatcccattcaaattcgaga

SEQ ID NO: 16360 - DNA, 263 bp, Homo sapiens
ctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagactggaggagagatttgaaaagtggagcattcaagacttttctttccaacaaga

SEQ ID NO: 16361 - DNA, 139 bp, Homo sapiens
attacttagtgtaacatgggtccttagctggtcagggctctccgtccacaccatacttctttacatttcctttagcaagtgaatttaattggtacttcaaccaaattggcacaaaaggttgtcttttcagtcaagggaa

SEQ ID NO: 16362 - DNA, 195 bp, Homo sapiens
tgaaggtgcgagctataaacctccagaatattttagtctacataggttaaaagtagtcatggataactacattacctcttcttgtcctaataagtttctttttattccaatccactaccactttagtaatattcactggttttacacagaggaagtccaaattaaggttgacacatacaggactattctccaaaa

SEQ ID NO: 16363 - DNA, 197 bp, Homo sapiens
gcaggagtgtaaactgtcctcagatgctcagagtttgcttcttgtcagtggaaggtgggatatgggtttgctactttagcgaacttccttggttcatgaggatgttttttatcttctggaaatattttggtgagcagggtcaggggtttctctttttttggagcctgacccaggaggccatagacctgaggtcgagg

SEQ ID NO: 16364 - DNA, 178 bp, Homo sapiens
agaggcccatctccaccagttagattaactttggataacttgcttctcctcttaaaataaatatcttctcgcaaagtcaagaatgttcacatttcatttctgatcaggtcaatactagttgacaccactgtgtcccaaatcagtccagatagtttttttagaagctaaaccaagtccc

SEQ ID NO: 16365 - DNA, 161 bp, Homo sapiens
cctttgttggtggtatgcttggcggtgaggctgtggttcggctggcggtctcggtgtttgggcgccgtcggtggctgtctgggggtatgtggaccgcacctcggtggcttctcttttctcgcggygagggcctgttttccgcccctgtctggctgtcgcgc

SEQ ID NO: 16366 - DNA, 238 bp, Homo sapiens
gagaacctcgttgccactcacatacaccgtggagaagctctgggtcctgatgactgtttcttaaaggtacttcaagaccctttagtctctgcaaccccagtactccaatttaaaaccttgaggctagcaagttccatcctcagccccatacccaggcactttccacctcctctcccagaattctgtttccagcacctccacccactgagattatttttgctgtggggtctctctacaa

SEQ ID NO: 16367 - DNA, 213 bp, Homo sapiens
ttgtgccttggtgattgattgattgattgactggttgttttaactgattactgtagatcaacctgatgatttgtttgtttgacattggcaggaaaaatgcagctttcaaatcattggggggagaaaagggatgtctttcaaggagttattttaggttaatttccccgcctaattgaggcagaactgtttgttatgtaccctaatgctaaataa

SEQ ID NO: 16368 - DNA, 149 bp, Homo sapiens
tttaagtgacggagtccacaagatcgaatttgacatgggactacatcaggcaaacgagtagtatatgtagatgggtagggagagataagattaagagtggatgtttaaattagtgggcaaagataccttgtgttttggtgctgcaaaga

SEQ ID NO: 16369 - DNA, 240 bp, Homo sapiens
  misc_feature 220: n = A,T,C or G
aacactggtgcacttgccttcatgtggacatatatcttcatttatctggggtaaataccttaggagtaggattcctgggtaatgggtagccccgggttaacttagaaggaggcctccaaactcttctgaagggggctacagggttacggggccaccgccacggtatgagttccagtgtttcccaatccttactaccaacacttggggttggcatattagncgacctaatcaggggggata

SEQ ID NO: 16370 - DNA, 265 bp, Homo sapiens
gaaactagaacaagaacgacaacggctacaaatagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttt

SEQ ID NO: 16371 - DNA, 312 bp, Homo sapiens
tcgacactagtggatccaaagaattcggcacgaggaattttaccataaaaacagtataattcttaggttcttatgtcagcctacaaaagtctgtctattctaccctgtctataaaatgtagtattattttacctaattgccatttagaacattttttcaaggatgaactttaatactgaaattctgagatatgacttttagttcagagtttatgaattgggcattggtagggtgtatatgtgtatgttggtgaaaatcagtaagccagtatctgccatgtgatagcgataataaagtcatgaaacctgtcca

SEQ ID NO: 16372 - DNA, 363 bp, Homo sapiens
aagcgcatgtccccctatgggcaacactttaggcactaaaaaaccaaccgtggcagagagagtaaagaaatataagccccatagtaagtgcatttaagcggcgccccaaaaaagaaagctgtccaatcatcaacacccactacctagaagatcccaatctatccagaacaaatctcggtgggaggtgaatgggacccgtagtttcgtcgtacgtccatgtccggatccggagtaacatatacaaccgaaaacagaggcggcggcttcgtctaccatagaaataagaagctcgcaactctagcggcgttaggcccttattcccagtccccccttttatcccggtcggtatagatggcgacgggc

SEQ ID NO: 16373 - DNA, 341 bp, Homo sapiens
gccaactcatttttgacaaaggcaccaaaaacatacattgagggaaagaacagtctttttaataaatggtactggggaaattggatattcacatgcataaaaatgaaactagacccccacctttcaccatatgcaaagatcaagtcaaaacggattaaacatttaaatgtaagaattgaaactacaaaactactagaaaaaacactgggaaaatgcttaaggtcattggtttgagcaaatatatatatttttaaaataagacttccaaagcacaggcagcacaaacaaaaatagacaaatgggattatatcaagaaaaaaaaaaaaaaaaaaaaaaaaaaa

SEQ ID NO: 16374 - DNA, 362 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgc

SEQ ID NO: 16375 - DNA, 359 bp, Homo sapiens
aatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggca

SEQ ID NO: 16376 - DNA, 360 bp, Homo sapiens
atgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgacttttttttttattcccttgactcaagacagctaacttcattttcagaactgttttaaacctttgtgtgctggtttataaaataa

SEQ ID NO: 16377 - DNA, 214 bp, Homo sapiens
taatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttt

SEQ ID NO: 16378 - DNA, 556 bp, Homo sapiens
acttaaacggatgatcatagctgaaaataatgatactgtcaatttgagatagcagaagtttcacacatcaaagtaaaagatttgcatatcattatactaaatgcaaatgagtcgtttaacccttgacaaggtcaaagaaagctttaaatctgtaaatagtatacactttttacttttacacactttcctgttcatagcaatattaaatcagaaaaaaaaatgcagggaggtatttaacagctgagcaaaaacattgagtcactctcaaaggacacgaggcccttggcagggaatatttaaagcaacttcaagtttaaaatgcagctgttgattctaccaaacaacagtccaagattaccatttcccatgagccgactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcgggccttatacatctgg

SEQ ID NO: 16379 - DNA, 539 bp, Homo sapiens
ggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttgg

SEQ ID NO: 16380 - DNA, 360 bp, Homo sapiens
gggagatgagtttgtatgctgtactatgcagcgtttaaagttagtgggttttgtgatttttgtattgaatattgctgtccgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaa

SEQ ID NO: 16381 - DNA, 430 bp, Homo sapiens
ggtaagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagctgaggataactaaaacttcaaatac

SEQ ID NO: 16382 - DNA, 519 bp, Homo sapiens
ggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttataccggaaaaaattgtattgaaaacacttagtatgcagttgataagaggaatttggtataattatggtgggtgattattttttatacctgtatgtgccaaagctttactactgtggaaagacactgtttaataaaagattacatccaa

SEQ ID NO: 16383 - DNA, 568 bp, Homo sapiens
gagcatggtttgccctttgattatgcagtacatttatgtttcttttgtttactgtatttcagagggacgcatttatagaaatactgtcaaatagattcttaccacatgttaggtaattttacgaaaagcaaaccaacagagatctctgcatttatgtttcctccctttaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgccacaatgatgaaatctctggccttgacttagcagtcaaatcaagggctggctcgtgactgctcagctgacaaatacgtgaagaactgggacatcttaggagataggccaagtctagtcattctagggacatgaaaatgggagtcccttctgtc

SEQ ID NO: 16384 - DNA, 337 bp, Homo sapiens
aaacatgctaataaacctaaaagtggaatcagcttcttcaggaggacttgaattctgtcactggagaaacacaagtagaaatgggaccaacattttgtgagatattcatgactttttgaattatcatctataaattatatactactgagtctgttgttacaaatcactgtaaacatagttacatgtggcccatataataaaaattaggaaatatggccaggcgcagtggctcacacctgtaatcccagcactttgggagaccgaggcgggtgggttgcctgagctcaggagttcaagaccagcctgggcaacatggtgaaaccccgtctctactaat

SEQ ID NO: 16385 - DNA, 294 bp, Homo sapiens
gtggataggactgccaaaggcgggtttctcagctatagcactgcccaacatcagaaattctgacggctatgattactatgccttttctaaagaccaatactataacattgatgtgcctagtagaacagcaagagcaattactactcgttctgggcagaccttatccaaagtctggtacaactgccttagactgatgagcaaaggaggagcaactaatgaagaaatgaataataaattttgcactgaaaaacattttattaataaagaatattgacatgagtaggaaaaaaaaaa

SEQ ID NO: 16386 - DNA, 381 bp, Homo sapiens
ctaactatggaaaggaaaaactggttgcagccactgcaaaaacataccaaattgtaaagaccatcgacactgtgaagaaactgcatcaacgaataggcaaaataaccaggtagcatcacgatgacaggatcaaattcacagataacgatattaaccttaaatgtaaatagtctaaatgccccaattaaaagacacagactggcaaattggataaagagtcaagacccattggtgtgctgtaattcaggagacccatctcacgtgcaaagacacacacaggctgaaaataaagggatggaggaatatttaccaagcaaatggaaagcaaaaaaaaaagcaggggttgcaatcctagtctctgataaaacagactgtaaacca

SEQ ID NO: 16387 - DNA, 139 bp, Homo sapiens
gtaagagctaacactgtataagattcttataataaaacaaaggtgtacatctttgtgaccttatattaggcaatgtttcttagatacaaaaccaaaaacacaagctacaaaagaaaaaaaaaaaaaaaaaaaaaaaaaa

SEQ ID NO: 16388 - DNA, 102 bp, Homo sapiens
aaaactaactaattgaattatagtaagtgggattgagggctctgcagtggggggtttttcttttctcatatttccaaaggggctttatttttttttgtaaga

SEQ ID NO: 16389 - DNA, 472 bp, Homo sapiens
gagacacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgtgctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgaaataagtgaaaaactcaagaaaggcatctgtgaagctctagaagactccgatggaagacaggactctccagcaggggaactgccaaaaacggtccaacagccaacagtgcaacacagatatctg

SEQ ID NO: 16390 - DNA, 118 bp, Homo sapiens
  misc_feature 86, 87: n = A,T,C or G
cttgggctcaggaccactgtttagaggactcttagattaaagttgaaacatcatatcagttaccttcagtcaaaaagatgcaaaannaaaaaaacaaaaaaaaaaaaaaaaaatttgg

SEQ ID NO: 16391 - DNA, 219 bp, Homo sapiens
agaagtagtcatcatggccgggcaagttgtctcacgcctgtgatcccagcactttggggaggccaaggcagatggatcacgaggtcaggagttttgagaccagccttggccaacattggtgaaaccctgtctcttactaaaaatacaaaaattagccagatgtggtggcaggcacctgtggtcccagatacttgggaggctgaggcaggagaattgctt

SEQ ID NO: 16392 - DNA, 249 bp, Homo sapiens
ttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtccagtatattttgctaagttttggaaagcaggttttttcccttcaaaaaaatta

SEQ ID NO: 16393 - DNA, 287 bp, Homo sapiens
aggatttaaaactggaacggtgaaggtgacagcagtcggttggagcgagcatcccccaaagttcacaatgtggccgaggactttgattgcacattgttgtttttttaatagtcattccaaatatgagatgcattgttacaggatgtccttgccatcctaaaagccaccccacttctctctaaggagaatggcccagtcctctccaagtccacacaggggaggtgatagcattgctttcgtgtaaattatggtatgcaaaatttttttaatcttcgccttaatacttt

SEQ ID NO: 16394 - DNA, 158 bp, Homo sapiens
cttgtgtgtctgaacacacagtagctaattagcaagctttttgagaacgtatttaaaaatcttactagcgattgacaatttttgcttgaatttctcgtataaaatacgccttattacgtggacgaacgtacttttcgttcaaaattttgaacaatttt

SEQ ID NO: 16395 - DNA, 166 bp, Homo sapiens
  misc_feature 96: n = A,T,C or G
taattcatatcattcatagagatcaggaagtcaatcaaataagtgtgatcacagaaacatacacaataggcactgacatgggtccaatatatattngcacattacagtaatgactaattcttcagcttaaaggaaggacctccagattcataaaccctattcaggt

SEQ ID NO: 16396 - DNA, 288 bp, Homo sapiens
gggcaatattggcattagttggcagtggcctgttacggttgggattggtggggtgggtttaggtaattgtttagtttatgattgcagataaactcgtgccagagaacttaaagtcttagactggaaaaagtaaagaaatatcaacttccaagttggcaagtaactcccaatgatttagtttttttccccccagtttgaattggggagctggggggaagttaaatatgagccacttggtgtaccagtgcattaattttgggcagggaagtgtgcataatttggatactg

SEQ ID NO: 16397 - DNA, 241 bp, Homo sapiens
  misc_feature 23: n = A,T,C or G
cttgctagaggaggaagccctangaactcaagggagataggggtggcaggggcatacctggatgcctggagcatggagggtgcgaaataaggaggtttcctaccccattgatgagctgaagttgattccgcaacggaggaggaaagggataggaagcataattggatgtgtaagcctgttggttcttcaggaagttaacacgtggacctaacactcttggatgctgctgaactctcagggg

SEQ ID NO: 16398 - DNA, 126 bp, Homo sapiens
  misc_feature 23, 24: n = A,T,C or G
atggctctcgtttcaggcctccnncggtgtgcaccttggagtcaggaggcgcgcttgtgcgtacagttcggttcagttactaaaaggatgtaacctgaactgcggatcctgtggtgaaatatcttt

SEQ ID NO: 16399 - DNA, 160 bp, Homo sapiens
gatattatgtatttggatagaactctgagaaaaaggtaatagcacatttcgcctttgaggatgagcttgccacattagataggagagagcctataagtggaaaagccagaggatgaggattaaaagaaattggcatcttgggaaaaaaaaaaaaaaaaaa

SEQ ID NO: 16400 - DNA, 356 bp, Homo sapiens
gctcttacaggcctgtcacagtggctcatgcctgtagacccagcattttaggaggcagaaatcggaagatcacttgaggccaggagtttgagaccagcttgggcaacatggcaagctcctgtctctacaaaaaaatcttttttttaattagccaggtgtggtggtatgtgcctttagtcctagctacttgggaggctggggcaggagaattgcctgagccctggagttagaggatacagtgaacatgcctatgccgctgtgctacaggctgggcgactgagacctgtccttaaaacaggaatacagaggaagaagcaggaagaaggaggaagagctaagagcttccactcatataw

SEQ ID NO: 16401 - DNA, 304 bp, Homo sapiens
ggagtagcgatgtatgctgtgtcttggtgtttcacgtttagcatctggcgctttgcatggaggaagagcatcaagaagtaccatgcttggagaagcaggcggagtgaggaccgccagctgaaccacaccggacatctcaaaatacactagccaaggcttgctccagattatggattgggttaagtcagccatgggacccaggttggaaatatgactgttacataattacacttataacaaacttaggtttcaataaagggctaaatgtattgatcaatttaaaaaaaaaaaaaaaaaaaggggg

SEQ ID NO: 16402 - DNA, 234 bp, Homo sapiens
gcaaaatagtgggaagatttataggtagaggcgacaaacctaccgagcctggtgatagctggttgtccaagatagaatcttagttcaactttaaatttgcccacagaaccctttaaatccccttgtaaatttagcttttagtccaagggggaccagctttttggacactaggaaaaaaccttttagagagagtaaaaaatttagcacccatagtaggcctaaaggcagccacca

SEQ ID NO: 16403 - DNA, 163 bp, Homo sapiens
gcaggcacctgtagtcccagctatttgggatactgaggcaggagaattgcttgaatcctggaggcagaggttgcagtgagctgagaccgtgccactgcactccagcctgggcaatagagtaagaccccatctaaaaaaaaaaaaaaaaaaaaaaaaaaaaaaa

SEQ ID NO: 16404 - DNA, 243 bp, Homo sapiens
  misc_feature 30: n = A,T,C or G
tgtttctatccccatctcagtgttttcttnatccatcccagtgatgccttatttgaaactgggcttaaactgcaaaaagaatgaagttggatttaggaagctgttagatcattgagtggtgttgggagtgaagtttcactagcagggagtttccttgagcctaaaataaaaggaaaaagttaaaagatcagttttttcaattaaaaaatagagagctgttaggctcctaattcgtggggtttt

SEQ ID NO: 16405 - DNA, 320 bp, Homo sapiens
gaggctcactggcaaactaaatatagacaaatacagaatccttcaggactataatggtagtgcacttttaattctggtccagaattgacaagacaaagcataaaaatagctgtaactggccaggcacggtgacccacacatgtcatcccagcacttgggaagatttcttgaagccaggagtttaagaccagcctgggcaaaaaagtgaagccccatctctaaaaatcaaaacaaacactgtaactataaagctatgttaacatatctctaatgggtacgaactatgtaaaggtgtaatttgtgacatcaataattttttt

SEQ ID NO: 16406 - DNA, 262 bp, Homo sapiens
  misc_feature 14, 57, 58, 65: n = A,T,C or G
tgaaaaacattttnttaataaagaatattgacatgagtataccagtttatatataanntgttttnaacttgacaatcattacactaaaacagatttgataatcttattcacaggcggtattgtttacagaccatttaattaatattgcctctgtttattcctcctcttccctcccattgcatggctcacacctgtaaaagagaaaagagtcaaattgaatatatctctcgaggactcaaaactagtgtattcacattaccct

SEQ ID NO: 16407 - DNA, 183 bp, Homo sapiens
tctatctactgaaatgtatttgacattcaggaggttatattcgggccctccattttataggatattgggactattatttggtcagggttaaagccattaatatggtttatccatttgataattttacaggaaggaggggcttattccattttgacagggtatcaaagatgtcactttcccaca

SEQ ID NO: 16408 - DNA, 107 bp, Homo sapiens
  misc_feature 33: n = A,T,C or G
aggctgtaatgcagtttaatcagagtgccattnttttttttgttcaaatgattttaattattgggaatgccacaatttttttaatatgtaaataactaggtttaaaa

SEQ ID NO: 16409 - DNA, 173 bp, Homo sapiens
gtagtatttagtcagtagattaaataaatgtatcctttgctttggagcttacaaacaacctaatgctgttttactctattaatatgcattggctctctgccctttggagttgacgcatttttgtgcattagcttttagggagagaccgcatagagatcgattgaacgatactt

SEQ ID NO: 16410 - DNA, 199 bp, Homo sapiens
taaggagattgtaagaacattctcagtttattggatatcccattactcttttttttggagaaggacgtgataaagaagtaagcatgatgaggctgaagaaaaggaagacaaagaggaggaaaaagataaagaggagaaagagtcggaggacaaacctgacattgaagagtgttggttctaatgaggaagaggaaaagav

SEQ ID NO: 16411 - DNA, 127 bp, Homo sapiens
atctgacagttactcttcagttttggcttaccttggtcatgcttcagttgtacttccagtgcgtctcttttgttctagctttgacatgaaaagatagggtttgaggttcaaatttttgcattggtgt

SEQ ID NO: 16412 - DNA, 147 bp, Homo sapiens
cagcatcagcacgcacaatgcagctcaggcgcttagcctagccacacccccacgggaaacagcagtgattaacctttagcaataaacgaaaggtttaactaagctagttactaaccccagggttggtcaatttcgtggccagccacc

SEQ ID NO: 16413 - DNA, 116 bp, Homo sapiens
ttgtaattaactgttagtcaagaggaacagctctttggacactaggaaaaaaccattgtagagagagtaaaaatttaacacccatagtgggcctaaaagcagccaccaattaagaa

SEQ ID NO: 16414 - DNA, 129 bp, Homo sapiens
atggaagtagttacattatagattactatggaaccagacttacaagacttagtattactaagtgaaacatttagaaaacgcaattatatccataaataattttttaaaaggaaacaagattttgaggcc

SEQ ID NO: 16415 - DNA, 173 bp, Homo sapiens
ggcagaggaatagctacatatttggcaattctcctctctgtagtcaccctgacatcctcacaagaaaacaaatctagccatttcccaaactttaaatttgatctctattagggctgcttaaaggctcaaattttcttcagctttctctcataaagtcaattgcaaaaggttct

SEQ ID NO: 16416 - DNA, 227 bp, Homo sapiens
tgtctactgtggatgagggatgaacaaggggatggctttgatccaatggagcctgggaggtgttcccagaaagcttgtctgtagcgggttttgttagaattaacactttccacttttttggacaccttatactggatgtattggttccaggattttggattttgatttttccaaaatgtagggttgagaatttcaaataaaactgtggctctgttttttctaaaaaa

SEQ ID NO: 16417 - DNA, 182 bp, Homo sapiens
cgaccacgcacacgagacatgcctctcgcaaggatctccttcatccctctccagaagaggagaagaggaacacaagaagaaacgctttggtcagagccccaatttcctacttcattggatgttaaaatgcccaagatgctataaaaatcaccacggctctttagccattcacaaacgggtag

SEQ ID NO: 16418 - DNA, 498 bp, Homo sapiens
gccattagagaagaactacgaccttacaatttaaatggctctacttcaaaaacgttaacaagaagaagcaccatttggcaacatgtttttactatgtgcaaacactgttaagaaccttcccaggaggttatagcccaaataataagacctggcttcagaatgtctgggttcaaatcccagacccattccttcctggacatgtggccctgagcaattatttaacttctctgggtctgagtctctttgtctggaaaatggaagtgctaataattcctccattgcagcgttcagaaaggactatgtgaggcagtgcagaaagaggcatttaatagagcgcatggtacgaagcacttaataaacgttcatgtttatcgttattacaaattctctcagattaggccacctattacccctgtctacagcccagaaatttgaggctggaaagagggtaagtgtccacatggtggaatattattcagcacaaaaaaaaaaaaaaaa

SEQ ID NO: 16419 - DNA, 508 bp, Homo sapiens
gaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaaggttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatt

SEQ ID NO: 16420 - DNA, 321 bp, Homo sapiens
tacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaaaaaaaaaaaaaaaaaaaaaaaaaaaaaaaaaaaaaaaaaaaaaaaaaaaaaaaaaaaaaaaaaaaaaaaaaaaaa

SEQ ID NO: 16421 - DNA, 511 bp, Homo sapiens
aaaaatgactgatcaaaggcaggcgatacttcctgttgccgggacgctatatataacgtgatgagcgcacgggctgcggagacgcaccggagcgctcgccagccgccgcctccaagcccctgaggtttccggggaccacaatgaacaagttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgcctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagtctgcttgaaacataggagctgcc

SEQ ID NO: 16422 - DNA, 155 bp, Homo sapiens
tatttaacagaatacctgtggaggaaataaagcacacttgatgtaaaaataattgttttatttttattgacatgactgattgattgctattctgtgcacttaattaaactgattgtgatgactttccaaaaaaaaaaaaaaaaaaaaaaaaaaaa

SEQ ID NO: 16423 - DNA, 271 bp, Homo sapiens
ccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggcgaaaaagcaaatgccaaaataaaggatgaagatca

SEQ ID NO: 16424 - DNA, 289 bp, Homo sapiens
tgtttgtgcgacatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatat

SEQ ID NO: 16425 - DNA, 284 bp, Homo sapiens
ctcaggaatactttaatgttagagatgaaagtgggggccaggtgggcagatcactggaggagaggagtctgagaccagcctggccaatgtggtgaaaccccatctgtactaaaaatacaaaaattagccaagcattgtagcaggtgcctgtaatcccagctaacaggaggctgaggtaggagaattgctggaacccgggaggtggaggttgcaatgagccaagattgcaccactgcactccagcctgggcaacagagcgagactctgtgtcaaaaaaaaaaaaa

SEQ ID NO: 16426 - DNA, 170 bp, Homo sapiens
gactccgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaaaaaaaaaaaaaaaaaaaaaaa

SEQ ID NO: 16427 - DNA, 557 bp, Homo sapiens
accatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgactatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgttttacttt

SEQ ID NO: 16428 - DNA, 532 bp, Homo sapiens
gggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctctgtctggctgcacccctttttcctgcccccaga

SEQ ID NO: 16429 - DNA, 605 bp, Homo sapiens
gatctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggtatggcaaaatcaataagaagcgaattgctttgacagataacgctttgattgctcgatctcttggtaaatacggcatcatctgcatggaggatttgatcatgagatctata

SEQ ID NO: 16430 - DNA, 198 bp, Homo sapiens
gctgcagggagctatgatcgtactgctacactccagcctgggtaactgggtgagaccaaaacatgaaatgaagtgtgaaaaataaagtatcttatacccttttagacatggagaaggttgctcttgattatactaaattctggatttgcttcatatgtatttttcaggtagcttatttaaaactcgatgtacctcttg

SEQ ID NO: 16431 - DNA, 411 bp, Homo sapiens
tccacctcaaaaaaataaaagataataaataaataaataatcaaagagacagtatggtgtattactggatgatatattataagtcagcatttaaagagtcattcatcctttaatcattgtatgcagcaaacattaggagagcccaccacacagcaggttctgtgttaagtagtaaaaacacaagaaactgcaggaggtgcctgagttggagcaccactcaggtttaacatgggaaagggttagttaaggcatggctgtcctctgaagggccaagacttgaggtgagctttcaaaaatattcaagaaaaaaaaggatttatcataaagtaaaagcccagcgatacgtttcttaattatgcaaataattctgtgaataacacaaagacccactgtatcttatcagaaaacagt

SEQ ID NO: 16432 - DNA, 439 bp, Homo sapiens
ggcaagctccgttgggcgccttggatccatttccatctggttctgctgagacgcgtgtggctccctcccgcaacagccaaaatggtgaagctgatcgagagcaaggaagcttttcaggaggccctggccgccgcgggagacaagcttgtcgtggtggacttctctgctacgtggtgtggaccttgcaaaatgatcaagcccttcttccattccctctgtgacaagtattccaatgtggtgttccttgaagtggatgtggatgactgccaggatgttgctgcagactgtgaagtcaaatgcatgccgaccttccagttttataaaaagggtcaaaaggtggggggagttctccggtgctaacaaggaaaagcttgaagcctctattactgaatatgcctaatcatgctctgaaaaagtgtaaccagctaccaggctgttt

SEQ ID NO: 16433 - DNA, 266 bp, Homo sapiens
gttactgtgataccttaaatatccacagtctcactttgtccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaaa

SEQ ID NO: 16434 - DNA, 298 bp, Homo sapiens
gggattatgagggcaaacaattctgtatgatgctgtaattacccatacatgtcattacacatttgtcaaaacccataaaatgcaacacaaagagtgaatcctcatgtaaattataatatttagttaataataatgtattgatattggcttatcaattataacaatctaccccattaatgcaagatactattaatagggaaaattttgggaagagtgaggagatacatgttaactctctgtactttctgctcaattattctgtaaacttaacactgctctaaaagaagtctattaattt

SEQ ID NO: 16435 - DNA, 510 bp, Homo sapiens
acaaaaactgcagagtaagaaaaacttgtctgatatctgttaaagtgatctgtatacatgtaggcattctcctgtatatgtgcatacacacactcctaagttgtgtaaatgtgtacctgcctgcttgagtatgatgcattgctactatttctaaactaccaatttatttcccctgtgttttgaggactcaatctcaaagatgctgactgaaaaataaagtttttgaacaatttcatgaaggttgggttgtcgagatcatgagttctgtctctaatgacaactctgtggggaaatggataaactctgataaactctatcgcacttgacacaaatgtgaggctggaaggcagtacggtaatttatgaggccttttgttgtaaaaatgagagtggcaggatccgagtaaatatcttttttcctaagggtggaagatagggacttggaggagatcaattgtgtgggtgacagcatttggaaaatggttggatttggagcttcaggcatcatagg

SEQ ID NO: 16436 - DNA, 405 bp, Homo sapiens
caacatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctggtagtgatgataaattctgtaggagggtctattctgagccgttaacttcctgtaa

SEQ ID NO: 16437 - DNA, 464 bp, Homo sapiens
aatttaacaagtctaagaacttctaagccttccctcatcttcctgtcttcttctgagccctccaggctgttccagttctacctattacccagttccaaagttgcttccacattttcaggtatcgttgtagcaatggcacacttctctggtacacgtttcctgtgttagtccactttcacactgctataaagacataactgagactgggtaatttataaagaaaagaggtttaattggctcatggttttgtgggctgtacgggcttctgcttctgcagaggcttcacgaaacttacagtcatggcaaaaggcgaagggaaaacaggcacttatttacatggccagcaggagagagagagaaagagtgaaggaagaggtgctacacactttcagacaaccagatcttgtgagaactgtatcatgaaaacagcaaaggggaggtctgaccccatgattcagtcacct

SEQ ID NO: 16438 - DNA, 109 bp, Homo sapiens
agaagaaaaggacagtgttgaacatacaaaacccacccctttcctccccacactcatagcccttaccacgctggtcctacctatctacccttttatactaataatcaaa

SEQ ID NO: 16439 - DNA, 440 bp, Homo sapiens
ctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgacccaaagatataagaaattttgatatgctgcatgcagcacagaactttgaacctaggaggcagtcaataaatacatgagaaattc

SEQ ID NO: 16440 - DNA, 570 bp, Homo sapiens
  misc_feature 533, 534, 551, 554: n = A,T,C or G
acagcattcgggccgagatgtctcgctccgtgttcttagctgtgctcgcgctactctctctttcgggcctggaggctatccagcgtactccaaagattcaggtttactcacgtcatccagcagagaatggaaagtcaaatttcctgaattgctatgtgtctgggtctcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagataggtaagtggggatcgagacatgtaagcagcatcatggaggttgaagatgccgcatttggattggatgaatccaaattctgcttgcttgctttttaatattgatatgctatacacttacactttatgcacaaaatggagggtataataatggtacatggacatgacctcttataatccactnngaggctgctccatgttngangatccgaacaggtgct

SEQ ID NO: 16441 - DNA, 179 bp, Homo sapiens
atctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcataatcatgccaaacagctttatcatgatgttcaa

SEQ ID NO: 16442 - DNA, 350 bp, Homo sapiens
cttttaaatgtaatacctcctcatcttttcttcttacacagtgtctgagaacatttacattatagataagcagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccattttttt

SEQ ID NO: 16443 - DNA, 529 bp, Homo sapiens
cagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagtcgacttactgaagaatggagagagaattgaaaaagtggagcattcagacttgtctctcagcaaggactggtctttctatctcttgtactacactgaattcacccccactgaaaaagatgaagtatgcctgccgtgtgaaccatgtgactttgcacagcccaagatagttaagtgggatcgagacatgtaagcagcatcatggaagtttgaagatgccgcatttggattggatgaattccaaattctgctgcttgctgtttaatatgatatgcttatacacttacactttatgcacaaaatggaggggtataataatgtaacatggcatgacctctttataatc

SEQ ID NO: 16444 - DNA, 554 bp, Homo sapiens
gaaggagacacacctcatatgcttctcaggccccatgtgttcatgcctgaagttactcccgacatggattacttaccgagagtacccagtcaaggcattatcatcaatcccatgctttccgatgagaccaatatatgcaatggtaagccagtagatggactgactactttgcgcaatgggacattagttgcattccgaggtcattatttctggatgctaagtccattcagcccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggcaaatagtggcagcgctttcaacagctaaatataagaactggcctgaatctgtgtatttttcaagagaggtggcagcattcagcagtatatttataaacaggaacctgtacagaagtgcccctggaagaagg

SEQ ID NO: 16445 - DNA, 502 bp, Homo sapiens
gcgaaaggcgagagctgcgaagggccatggtgtcttgccgctgattctcgttttcatcatatagacggaacagccctgctgcaaagatggtcaacgtacctaaaacccgaagaaccttctggtaagaagtgtggcaagcatcagcctcacaaagtgacacagtataagaagggcaaggattctttgtatgcccagggaaggaggcgctatgatcggaagcagagtgctatggtgggcagacaaagccaattttccggaagaaggctaagaccacaaagaagattgtgctaaggctggaatgtgttgagcctaactgcagatccaagaggatgctgccattaagagatgcaagcattttgaactgggaggagataagaagagaaagggccaagtgatccagttctaaactttgggatatttttcttcaattttgaagagaaaatggggaagccatagaaaagtacccgagggaaaataaatacagtgatattccaaaaaaaaa

SEQ ID NO: 16446 - DNA, 606 bp, Homo sapiens
cggagaaaaaggaatgcttatacactgttgatgggagtgtttatttgttcagccattgtgcaagttatgggtggtctgatgcaaaatgtctgcctcctactgggggactcctactttagtattacaaatacccacattactccaaccattcttcggaagatttatgtcccaaccctttttaggtactttctttttagaagtgtgaccaccttttggcaccagttctaaatggcaaatcacagaggcagacacgagaagctactgaagactgtgtggtgataagatcacagcgcaagtgccatgttcctcttgacatctctctaaagagacatgtgtagaaacttgtactacacagggaaaggctcagagctgcagtactgaaggaacagcagagaagcaaaagggataaccagaatcctcctgtagaatggcctacataaaatgccagtagttattagcttcaaatctgaagtctgcccagtaataaattgaagcctgggaggcaaagtgagagtagaatcacaaagcaaatggctttgcgattactagagaccagtaaaacacaaatattgttccagggaaagtggatcctatattattatggag

SEQ ID NO: 16447 - DNA, 233 bp, Homo sapiens
atatctgatatgtctcatatctctcatcccttcttttcttttaggaaagagatttcttcatcatgtgtttgtgaacacaccccagatgactatagcaagtaattattataataagtcatgaccactgtcctcagaggtcaagaaacttaatggaggagaggagggagaaagatgaattggtgaggattccaaggaggatcagaatgatttttagtcttcacactttgactagc

SEQ ID NO: 16448 - DNA, 307 bp, Homo sapiens
gatatagtaccgcaagggaaagaggaaaaattatagccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttg

SEQ ID NO: 16449 - DNA, 569 bp, Homo sapiens
tcccccaaaaaacctgggggcctaaaacaatacacatttattatttcacacaggttctaaaggctgggaatccgagagcagcttactggggtggttctggctcagagtctcttctaaggttgaaatcaagattttgattgggacagcagtcatctaaaggcttgaatggatctggagggcctgcttctaagctcactcatgtgggaggcctcagatctttagcacatgatcctcgtgatatgaggaactggcttccccagagcaagtggtcttagaagaagagagcaagcaggaagccacagtacctttatcacttgcctctgacatcacattctgtcgcttttgttttattttctccattagaagcgggtgctaagtttagctcatattcaaggggaaaagaattaggaccacctcttgaagggggggaggatcatagaatttggggcatatcttaaactgcacaatctaaaaagactcagacagggcctagcacataagtgccccataaatggcagtggtattctactattaaaaggcctaccctaatatacatatccaattaatat

SEQ ID NO: 16450 - DNA, 159 bp, Homo sapiens
tcccagtcttttcagcaacccggtccagtactgtgagatacagccaccacccttcagatgtgtctacgtgcgctctgccatggaactcggaaactataagtaattctcaagaaagccctcatttttataacctggcaaaatcttgttaatgtcattgcc

SEQ ID NO: 16451 - DNA, 511 bp, Homo sapiens
gaactcggcggtggccactgcgcagaccagacttcgctcgtactcgtgcgcctctcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagaagtaaaaccaagctggcccaagg

SEQ ID NO: 16452 - DNA, 606 bp, Homo sapiens
ttttccttgcattggggaaaaatatctttcatatttgtttgctgtaaagatggttttgcaagaataagtcatgaccaagacaaactgccaatacaaaagcccactgatactaattatataatgagaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgttgtacatgtatcttgacatttataaagccactgtgatctataaatcaagaaaatccattgtcataaccattttaaaagtcaaaaattaagacatccttaattaaaaagttcaaatctagacactaaatgtgtgtgaatgacaaagaaaacaaaccattgcttatgccggtatatctaaagaaaattggtttgctgctggttaacctgacagatgaaggactttagtgaacctcatattggaagaaccggtaaaaaaagtggcaaggaaaaa

SEQ ID NO: 16453 - DNA, 171 bp, Homo sapiens
ccagtggtcttctgtgtaaagtgagcgcaggaaatgaaaatgcttgtctgacaacaaagcatttaactgcccttggaaaactagaaccaaagctggctcctttggtgattgcatttaggtactgggcaaaggtaggcttgaggctttatgcatgaatacattctacatatg

SEQ ID NO: 16454 - DNA, 605 bp, Homo sapiens
ctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatgtcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctgcacctgattttgtatcccctgtagcagcattactgaaatacataggcttatatacaatgctctttcctgtatattctcttggctggctgccccctttttcccgccccagattgataagtaatgaaagtgccctgcagggagggtcaaaaggagaagcaacatatgggattggtccataataaacttctggtgtgata

SEQ ID NO: 16455 - DNA, 497 bp, Homo sapiens
cgtgttacaaagctcctctggccagtgcttggtaaatgtccgttcagccaggaccatgtatctggagaagcataagactaatcctctagtttctttgaaaacatctgctgcctagtccagtgaagctatctcccaccaaggccaaggaccacactcactaagtagttttatatttgcttggaagcttggaaatgattaaatcctcttcaaaaatgttttcatgaatctactatctaccaacacttatgtcattaattctcttatttctgtgcaaataaaaacatatttaagttcaccttcccataaaattaataatgaattaagaatcatagacctggccgggcacagtggctcacgcctgtagatcccagcactttgggaggctgaggcaggcggatcacaaggtcaggagatcgagacctgactaacacggtctggctaacacggtgaaaccccatcctggctaacacggtgaaaccccatctctactgaaaatc

SEQ ID NO: 16456 - DNA, 552 bp, Homo sapiens
tgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttccgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcaagaactgtttggttcaattggccatttaagttagtagtaaaagactgggtaatgataacaatgcatcgtaaaacctcagaaggaaaggagaatgtttgtggaccactttggtttcttttttgcgtgtggcagtttaaagtattagttttaaaatcagtacttttaatggaacactggccaaaattgccagaatttgagacccataaaaaagt

SEQ ID NO: 16457 - DNA, 250 bp, Homo sapiens
acggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactca

SEQ ID NO: 16458 - DNA, 530 bp, Homo sapiens
gtttatttctaattcaaacacttaagtagctttattgttaaactttgctatttaaaattggttataatttagattatgttcttataagattctatatttcctatctaaaatgttgttgtaattcaatttaaatgtgttcaggtacagtccccatcagtagcgtatagaacaccccactctcctttagtaaatgttgagaaaatgcctttgttgcatgctccaaatcccacactgggctgcacctgggagttctggataccgaaaggtcctttcccagaggttctgctgttgcatcagaggaggatgaccgtgctcgaggaggaagaatgggttcgagatcatcatattcatcagaaggggacactaaatagaacccttaacctgttgtacttgccaaaattgagaatcagagatgtgtaaaatgcacaaattaattataatgtaaggtaagaattgctttttgccaagtcgcaaagttgtatccacatcaggtcactgtaaaaatatattatcttgtaaaacttatggtc

SEQ ID NO: 16459 - DNA, 518 bp, Homo sapiens
agggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaa

SEQ ID NO: 16460 - DNA, 530 bp, Homo sapiens
gtttctttattatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgcaccttaggtagtaggaagaattacaatttctttaaatcatttatctggatttttatgttttattagcattttcaagaagacggattatctagagaataatcatatatatgcatacgtaaaaatggaccacagtgcct

SEQ ID NO: 16461 - DNA, 669 bp, Homo sapiens
ttatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaacttccttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtcagaagtgccctggaagaaggcctgctctaaattatccaggtatggagaaacgacacagggttaggagacgcgctttgaacggctataggacctctcaaacaccccccatcagaatcaatattcacctgccagactggcttatcaagaaccaaaggggccttcataatgaaggtaaagggaggataccggggagagggccttccaaagggggtaccccaactttttaccggcc

SEQ ID NO: 16462 - DNA, 564 bp, Homo sapiens
gggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattgggctgtaactactttataactaacatgtcctgcctattatctgtcagctgcaaggtactctggtgagcaccacttcagggctttactccgtaacagattttgttggcatagctctggggtgggcagttttttgaaaatgggctcaaccagaaaagcccaagttcatgcagctgtggcagagttacagtctgtggttcatgtagtacctatagtactgtgtaatagtg

SEQ ID NO: 16463 - DNA, 659 bp, Homo sapiens
aattaattgatggatcttaaggaaagaaaaactgatctccagaactttttcatcttgctaaactgaatttctgtacccattaaataactccccatttcttcgtcccctaagcctctagcacccaccattctgctttctgtttctatgaatttgactagcgtagtcaaatacacagaaacagaaaacagaatgttgggtaccagcggctaaaaatctattgatgttaataactaactaacgatcaaactataaaaaggaaataagctgcatgaaaaataagtaaagcaatggatacaggaaaaaaactgagttaagtcagggaacacaagaacttaatgttttttgattaaataagacaattattccatcaaataaggaaatatgctatgaaaaaggacaggaaacaataatgagctcttggaaattaagaaaaaaacgtacaccccacccctgccaaatgcaatagaaaatatagacgttaaaggtgaggaaacatagcaaaaggaaataggaaatatgaggaggtgatgtggagaacttccccagaacccaatgtaagaaatcctagatgaaaatagtgacctgatcccactggggtccagaaatatatcttgaaaagaatcagctctatgccataaatagtaaaaagccggaagagg

SEQ ID NO: 16464 - DNA, 560 bp, Homo sapiens
gaagacaaaatttgtcagagtgaattttaaaaaaaaccaactaggccaagcacagtgctgggattacagggtgcgcaccactgtgtccagcctaaaattctatatccagcaaaattatccttcaaaagtgaaggagaaatgaaataagtactttctcagacaaataaaaactgatggaattcagcaccagcaaacctgcactttaagaaatgttaaaagattttcttcaggcaactgagatctacataaagaatgaaagaggattagaaatgaaataaatgaaagtaaagaaaaatatttatttttcttattcttaattgatctaaaagataactgctgaagaaataatagcaacaatatactgagtgattatagggggatgagtaattgaaatgaatgacaaatgctctgcattaaggtatgtgcactacatacaaggtaagcataagagtggtatctgaaagtggacttggctggggcacgggtggctcacgcctatagcccaagcactttggggagggccgaggcaggggggatccgaaggccaggagatcaagggg

SEQ ID NO: 16465 - DNA, 447 bp, Homo sapiens
caggcgggctcttagaaactaacgagactggatttcaaagcagctatctgggcaaactgtttattccagcgatgtgacttttttcagaatattccttggaatcatattcagagtctggggctgcgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatgccaccgttgcattgtgagtctatagcttgactccttggagaacaatattcatttggttgtggagactgatttgctgggagaaatctgcctgtactttctggtcatcccaggtctgacttttaccaggg

SEQ ID NO: 16466 - DNA, 459 bp, Homo sapiens
aaaatgatcaaattagggttgcacacaaattgcatcacctgcaagcttttctgatgaattgagtgtgacgtattgatatagaaatgaaatcaaggatgatgcctaaggtttgagtgctcttatacaagcacaagtgtacatatatgtaaaatcatgaccaaatagattttattccaagaatgcaaggatgattcttgcattgatgtgtgataatcatcaaaattcaatatgtgctcctgatttttaaaataataagaatgatgtatatttcttaacatgatgatttcagtcctaacatcagcatagctaacacgtcttgcatatggggaaacactagaggaattctcacttaggtcaggaaccaagacaaggatacccactatctgcattaactgttggatatcctcccagcacagtcaaataagataaaacactatccaggggggatggctctgattt

SEQ ID NO: 16467 - DNA, 554 bp, Homo sapiens
gggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatgccgcatttggattggatgaattccaaatctgctgctgctttttaatatgatatgctatcactacactttatgcacaaaatgtagggtataataatgtaacatggacatgatctcttataatctactttgagtgctg

SEQ ID NO: 16468 - DNA, 523 bp, Homo sapiens
gaagagaggtggcaagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacccga

SEQ ID NO: 16469 - DNA, 163 bp, Homo sapiens
caacaagggatttttacaaagatataggtttagaagctggtaggctgactagagttgatactaaacgagcagtagggaaagaacagaagcaattgcatttacaccaaacatacccaaaatgtttaggttccagatacctatggaagtgaggatgtagtgggaa

SEQ ID NO: 16470 - DNA, 423 bp, Homo sapiens
atgatgttcaagaccaagaatcagaagctcctggatgccttaaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgcttagtgcggtgataggaagctaaaagtgtcaagcgttgacagcttggaagcgttatttatacatctctgtaaaaggatattttagaattgagttgtgtgaagatgtcaaaaaaagatttagaagtgcaatattata

SEQ ID NO: 16471 - DNA, 462 bp, Homo sapiens
  misc_feature 64: n = A,T,C or G
cgcaatagatatagtaccgcaagggaaagatgaaaaattataaccaagcataatatagcaaggnctaacccctataccttctgcgtaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccccaattaagaaagcgtcaagctcaacacccactacctaaaaaa

SEQ ID NO: 16472 - DNA, 370 bp, Homo sapiens
attgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgcca

SEQ ID NO: 16473 - DNA, 549 bp, Homo sapiens
taaacacaagtaaatgccagctggcatatcttaatcattgctatttcattttctaggagtggccagccaaaaattcactcttgtgtacagtctttgcctactcttacacatcctcactcagcttctgggccagccaatatggtgcatattcagcatgctaaatgcagggaatggcatcaataattggatatattttttaaaatatggcttttaaatgtgttcagggtagatgccggctaagccatacacgacagatgaattgtcttcctggatgcagaggaagcatggattcttattctgaagagttggtttctgtttgctattccactggttttcataatccaccagtataataaaccagtataatccacatcaccacttaactcatgaacctggtgatctatcctcctaacaattggaaagtaattactgaatttatgggcaataactgcattagtattctggttgcttgacattggtaaggacattattcccatgataagaggagaagatgaagaacactacttctgacccaagaaaaaaggccta

SEQ ID NO: 16474 - DNA, 542 bp, Homo sapiens
agaggcagccagcgcagggtcttctgctgagggggcattcggagcttgaggaaaccgcagataagtttttttctcattgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagaggaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaccggaagggggattaaaagaccttgaaatccatgacgcatgggagaattgcgtcatttaaagcctagttaacgcttttactaaacgc

SEQ ID NO: 16475 - DNA, 444 bp, Homo sapiens
gggcttctgctgagggggcaggcggagcttgaggaaaccgcaaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaa

SEQ ID NO: 16476 - DNA, 233 bp, Homo sapiens
caggaaacataagtggtttcgtttggctaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgta

SEQ ID NO: 16477 - DNA, 425 bp, Homo sapiens
atgacggatgaggactctgggctgctggaataggacactcaagacttttgactgccattttgtttgttcagtggagaccccctggccaacagagtccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagacccgggtgggtgagcgctggcttctcaaacgggcgaagttgcctc

SEQ ID NO: 16478 - DNA, 383 bp, Homo sapiens
tgggtaaaaggaatatgggtattccttgtgctattttcattttcgcaactttattttaatttaaattattttcaataagtttttttaaggaacctgaaaacacctacctcattttgaaattaaacaaacaaacaaggccaggcttcgtggttcatacctgtaatcctggcacttgggaggccaagttcagcagatcgcttgggcccaggagtttgatacgagactggcctacatggcgagaccctgactctacaaaaaatgcaaaacttagccagctgtggtggtgtgtgcctatagtctcaactagttggggggctgaggtgggtgaacagagatcgtgctactgcactccagcctgggtgagggtgacaaagtgagaacct

SEQ ID NO: 16479 - DNA, 321 bp, Homo sapiens
gaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 16480 - DNA, 201 bp, Homo sapiens
tagccccagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttacc

SEQ ID NO: 16481 - DNA, 379 bp, Homo sapiens
cacacacaaaacacacccacatatatgtacttaacggcaatgtttaattttaatatttttctccttattaaaaagtttaaaatggatgagaaagctgtgcttggtatttaccttcacagatgagtcttctaattgacttagagaacttaagaaaaactgaattaaataagcaatattgaattatatacatttacttatcaaatgtaagtttattagacattatcgtttatttccattgcaaaatgagaataaatgtagtcacaacaataaaacttcttacactaggaatttctagctgtgttgatattataagtgactttaaaatacccacctggggttgtagctggcatgaattttaaaatccagattggaatgcttt

SEQ ID NO: 16482 - DNA, 418 bp, Homo sapiens
ggccatcactgcaggaaaaggtcccggagagctgagcagtcaagatgcgtgacttcaccgaagaccagaccgcagagttcaaggaggccttccagctgattgaccgaacgggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccaggcacctatgaggattatgtcgaaggacttcgggtgtttgacaaggaaggaaatggcaccgtcatgggtgctgaaatccggcatgttcttgtcacactgggtgagaagatgacagaggaagaagta

SEQ ID NO: 16483 - DNA, 516 bp, Homo sapiens
ctaaaagtaagctaaaaattcctgctgaaacattccattcctttcatttagtataaaagaaatactgaacaggccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacagcagtgggtgtagaggtaaccagtagctttgagaagctcatgtagctcaccagtggttttctctaaggaatcacaaaggtgaactacccaaccacatgccacgtaatatttcagccattcagaggaaactgtgttctctttatttgcttatatgttaatatggttttaaatggggacttttatataggatgggaacagtatggtaatcacacatcctatgcacacatgctttggggtccttccataatacttttatatttgtgaatcaatg

SEQ ID NO: 16484 - DNA, 423 bp, Homo sapiens
tattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatacttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtt

SEQ ID NO: 16485 - DNA, 445 bp, Homo sapiens
gtggagtccgctgggttgagcatcttctttcagcatgatccttttgagatgcagggatgttggtgtgtgtgtatcgggagtgtcttcctttaagaaattctttcccgtgagtatttcttcaagcctggatttctcatgaggctccaaactgcagaagatgagaagggagggctgtgtttcctgtgttctcagctcctggtgtgcagtaggtgctctgtagatgcttgttgaatgaatggatgggtggatgacaggcatgtcccagggatggagaaaggggagcagagaccctgctttggagtcctgtgggttctcaaaaagggcccactgccaggcgcagtgctcacacctctatcccagcactttgggaggcagggtagggggatcacctgaaggccgggagtttgagaccagcttgggcaacatggtgaaaccccgtctctac

SEQ ID NO: 16486 - DNA, 372 bp, Homo sapiens
attaaaatgtgcagtattttcagtgtcaaatatttaactatttagagaatgatttccacctttatgttttaatatcctaggcatctgctgtaataatattttagaaaatgttcggaatttaagaaataacttgtgctactaatttgtataacccatatctgtgcaatggaatataaatatcacaaggttgtttaactagactgcgtgttgtttttcccgtataataaaaccaaaggatagtttggttcttcaaatcttaagagaatccacataaaagaaggaaactattttttaaaaattcacttctatatatacaatgagtaaaatcacagattttttctttaaataaaaataaagtcattttaatggcct

SEQ ID NO: 16487 - DNA, 316 bp, Homo sapiens
aatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactc

SEQ ID NO: 16488 - DNA, 375 bp, Homo sapiens
cctcgttatgaaaagtgggaagtacgtcctggggtacaagcagactctgaagatgatcagacaaggcaaagcgaaattggtcattctcgctaacaactgcccagctttgaggaaatctgaaatagagtactacgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaagctgcaaaattttcctttaataaaatttgcttgttttaaaaacgg

SEQ ID NO: 16489 - DNA, 328 bp, Homo sapiens
tgggggcccttactgcattatcaagggaaaggcaagactgggacgtctagtccacaggaagacctgcaccactgtcgccttcacacaggtgaactcggaagacaaaggcgctttggctaagctggaggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactggtgagttttctgtcataaaaataattgaaataatacaaattttcctt

SEQ ID NO: 16490 - DNA, 463 bp, Homo sapiens
gagtactaacatggactaatctgtgggagcagtttattccagtatcacccagggtgcagccacaccaggactgtgttgaagggggttttttttcttttaaatgtaatacctcctcatcttttcttcttacacagtgtctgagaacatttacattatagataagtagtacatggtggataacttctacttttaggaggactactctcttctgacagtcctagactggcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgatgatgaggacaactctctttttccaacaagagagccaagaagccatttttttccatttgatctg

SEQ ID NO: 16491 - DNA, 508 bp, Homo sapiens
aatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggg

SEQ ID NO: 16492 - DNA, 373 bp, Homo sapiens
gcctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaag

SEQ ID NO: 16493 - DNA, 439 bp, Homo sapiens
  misc_feature 427: n = A,T,C or G
aactggattttttcattttactaggttccgaagagtccatatgcttggtagacgttcaatacgtgatttttggtttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtcacatacatagtcagtggtccattttaggaagccagtggcgtctgataaagaaatgttaagagtagtgaggttgagggaaggaaattgtgggatttgaaatattctctttatgttgtttctctctgagtcatgggaaaacaataaattatcatctctaggnggcaaaaaaaaa

SEQ ID NO: 16494 - DNA, 356 bp, Homo sapiens
tgggcggaattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggtataaaaatgttaattcagaattagtttaatgccttaattaaactaattaatagctttggacacttaaaagagctctaaatttgcttgacataaaggcttaatttgttttccttgttagggtcaaggggtcctccactctctaacagctgctggcagacacattagagcagctgttgtattgataataaaatattataaacc

SEQ ID NO: 16495 - DNA, 440 bp, Homo sapiens
ggtggagagagcgagctgagcggttgtgtggtcgcgtctcggaaaccggtagcgcttgcagcatggctgaccaactgactgaagagcagattgcaaaactcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatc

SEQ ID NO: 16496 - DNA, 548 bp, Homo sapiens
gctcttatccgtggcgcctcggaggcgttcagctgcttcaagatgaagctgaacatctccttcccagccactggctgccagaaactcattgaagtggacgttgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctggccccaaaagagctagcagaatccgcaaacttttcaatctctctaaagaagatgatgtccgccagtatgttgtaagaaagcccttaaataaagaaggtaagaaacct

SEQ ID NO: 16497 - DNA, 240 bp, Homo sapiens
cgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatcctcgaatcacaaaa

SEQ ID NO: 16498 - DNA, 526 bp, Homo sapiens
acctctgattacatgtatgttcttgtttgtatcattagcaacaacatgctaatgacgacacctagttctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatggctacatagtaagtacagaacagtaaagttaaaacggatgtctccattgatctgccaaatcgttatagagagcaatttgctggactagaaaatctgagttttacaccatactgttaagagtccttttgaattaaactcgactaaaacaagtgtataactaaactaacaagattaaatatccagcccagtacagtatttttaaggcaaataaagatgattagctcacctgagataacaatcaggtaagatcataacaatg

SEQ ID NO: 16499 - DNA, 207 bp, Homo sapiens
aacattgtcattgactataaataatagctgcaattctattgttggtttcttttttcactagtccattttgataatatttcttgttgtggccaggcacaatggctcatgcctgaaatcctagcactttgggaggccacggcagatggatcgcttgagctcaggagtttgagaccagcctggacaacatggcaagaccttgctctattt

SEQ ID NO: 16500 - DNA, 477 bp, Homo sapiens
aggagcctctctccctactgctgctacacaagaccctgagactgacctgcaggacgaaaccatgaagagcctgatccttcttgccatcctggccgcctgagcggtagtaactttgtggtatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgct

SEQ ID NO: 16501 - DNA, 556 bp, Homo sapiens
actggtggaattgatgatatgtgtctgaagtattttgtggaggctggtgctatggcagttagaagagttttaaaaagggaccttaaacgcattgccaaagcttctggagcaactattctgtcaaccccggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaacctgtggttcccggtgggggtgctgtagaagcagccctttccatataccttgaaaactatgcaaccagcatggggtctcgggaacagcttgcgattgcagagttttgcaagatcacttcttgttattcccaatacactagcagttaatgctgcccaggactccacagatctggttgcaaaattaagagctttcataatgagg

SEQ ID NO: 16502 - DNA, 522 bp, Homo sapiens
ggagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcctcagtatcagacacagcacagcagccatctgaagagcaaagcaagtcccttgaaaaaccgaacaaaaaaagaatcgctg

SEQ ID NO: 16503 - DNA, 319 bp, Homo sapiens
aagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagt

SEQ ID NO: 16504 - DNA, 353 bp, Homo sapiens
gaatgaaaaaaaccctgctgaatcatacagtaattttctttaaagcacatagtagttacataaaatatatatatataaaatatatttttggtttataactaacacaaggcagggatcttgtgactctaagagtgcgttttgtcatcaagacaaaacagatgcaagatgcatcactgcattacttccatagagttgtaaaataatccttaatattagaatatttttctgtcacttagcaaaagtggttcagttcattgccgcgcccatcatgttcttgactatttgatccactttttcgtttatgtcaaccccttccctctctggctaaataaagtggatgcagaaagctccct

SEQ ID NO: 16505 - DNA, 210 bp, Homo sapiens
aacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaattatctccctaattgaaaacaaaatactcaaatgggccc

SEQ ID NO: 16506 - DNA, 500 bp, Homo sapiens
gtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttg

SEQ ID NO: 16507 - DNA, 432 bp, Homo sapiens
catgtgacagccattgtgagactgatgcacaaactgcacttggttaatttaagcacttctgttttcgtgaatttgcttgtttgtttcttcatgcctttacttactttgcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggcctgctccacaggacataggcaagccttgatcataggtcatacatataaatggtggtgaaataaagaaataaaacacaatcc

SEQ ID NO: 16508 - DNA, 377 bp, Homo sapiens
aagatgaaatgttttgaaatgatatgaccaaaattttaagtaggaaagtcacccaaacacttctgctttcacttaagtgtctggcccgcaatactgtaggaacaagcatgatcttgttactgtgatattttaaatatccgcagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactggtttaataaaagatttacattcc

SEQ ID NO: 16509 - DNA, 146 bp, Homo sapiens
atagttccccctattttaaacatcttgactggccaggtgctgtgcctcatacctgtaattctaccacttagagaggctgaaatgggaggatagcttggactcaggagttggaggccagcctaggcaacatagcaaggccctgtttc

SEQ ID NO: 16510 - DNA, 220 bp, Homo sapiens
caagcgcatccatggagtgggcttcaagaagcgtgcactttgggcactcaaagagattcggaaatttgccatgaatagagatgggagctccagatgtgctcattgacaccaggctctacaaagctgtctgggccaaaggaataaggaatgtgccgtaccaaatccatgtgaggctgtccagaaaacgtaatgagtatggaagattcaccaaataaggttt

SEQ ID NO: 16511 - DNA, 521 bp, Homo sapiens
ggtggaagcttcgagtctcgactccactgttgacccctagacgagagtagtgcagcgacggggccgtgatgtgcgtcctggctttcttaacgacacctctcctctgtatttcctttttccagttgagtaccttggggtgaattattattgttactgttatctctgtcgttccttactgcttcgtggtattttgcttgataagcatgctctgcacccacctctgttcgccagaggttacttctgcaaagtaggaagaaacgagcaatacgatggtaatctttgcgcctttgctaggatcttttgtaggttccttatgtcttactagccacttgttgaagtcctgctcattcttaaactctgtcagatgttatttttcctgtaacttcgtgcattcactctcttcagaattaacaatttcttcctgtggaccctcgcttgtggtttgtacctggctttagcatgtttcattccgcttccactcttacgttgcttctatgtgtgcctctctggctctatgcagg

SEQ ID NO: 16512 - DNA, 400 bp, Homo sapiens
gagcgggagcgtgaggaaagccgtgcgttgcgttccaaggcatctgtgagcccgcggagtatacaccatgagcaaagctcaccctcccgagttgaaaaatgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaataggc

SEQ ID NO: 16513 - DNA, 282 bp, Homo sapiens
ggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaag

SEQ ID NO: 16514 - DNA, 383 bp, Homo sapiens
ggcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggc

SEQ ID NO: 16515 - DNA, 493 bp, Homo sapiens
gttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacaccgttgtaaccggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggctt

SEQ ID NO: 16516 - DNA, 482 bp, Homo sapiens
ttctccctcttcaaaacttaccttaataacggctgccttgcattactcataatagccaaaaggtagaagcacccgaagtgtctatcactgggtagatgaataaacaaaatgtcgatatatacatacaatagaatattactcagccttaaaaaggaaggaaattctgacacattctacagcatggatggacctcgaggacattatagtaagtaataagccaattataaaaagacagctaccatacaatcttgcttacataaggtacctagagtagtcaaattcttaagagacggaaagtagaattgtggtttccaggtgctgggggaagaaagaattgtttaatggataaagagcttcagtttttctagatgaaaaagtcttagagattgttgctcagaaatgtgactacacataacgctctgaactatacacttaaaaatggttaagatggcaaattacattatgtaaggtttaccacagtc

SEQ ID NO: 16517 - DNA, 529 bp, Homo sapiens
gtggatttgtcaactaattctgaagtgctgtagttatttgtgttttcatcgttttattgtttattttatttttaagatggagttttcgctcttgttgcccaggctggagtgcagttgttgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactaggttacatttgttagcctttcacatctgtgaaggaataaagtacagac

SEQ ID NO: 16518 - DNA, 144 bp, Homo sapiens
acatcacagctagttaaggttaagaagtattcatgaaaacttcgcatataattgttgggtaaaatttcctctctcttccatctgtgaagaaagaataattaggcattttggttatagctcattaaaaatagcttttatactttc

SEQ ID NO: 16519 - DNA, 358 bp, Homo sapiens
agtcgttggtgttagaagcaccagcacaatttgagcattcttattaacaaaggtgctcacagttgagaaactctcctgccgggcgcggtggctcatgcctgtaattccagcactttgggaggcagagttgggaggatcacctgatgtcaggggtgtgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactacatctc

SEQ ID NO: 16520 - DNA, 513 bp, Homo sapiens
gagataagagtcaccatcaacttattaagcatattacttaaaaggtactttgacacagacttcttttaggcaccagagccactgtaacattttttggtataacacaatcattttaaatttaaatcaaattataaatgttaaaaagtacagttaaaaagtacactgaaagtaagtaactgggcagaaaaaaattattttgtctttcaagtgagctttatattcaaagagattattttccaaagctatcataagaaagatggatttctgaagttttcattctgaaatgcaaactctttaaagccttccgactgattgttttatttggccaaagtgtaagccacatttatttgtaactttgaaagtatactctagtgggcatgatgcctttgactgaattttgtgggtggtgagtttgaaaggtaggcttcagccaactgattgtttcggagatgccagagagaagtattgtaaattgggttaatgttgtaggcatcctttaaaataaaatattta

SEQ ID NO: 16521 - DNA, 201 bp, Homo sapiens
aaacttgaagaacagagaccagaaagagtaaaaccttttttgacaggggctgcaagaacaaatcaagcacatgcttgcttatttcaaaaactaccagttctttattggggaaatcatgattccagatggcatggttgctctattggactaccgtgaggattggtgtggaccccatatatgaggttctttaaggaggggttt

SEQ ID NO: 16522 - DNA, 552 bp, Homo sapiens
gctagtatctcgggtgtatactctgtaagtgtagctcaaataggtcatcatgaaaggctaaaaaagcgaggcggccatgcgactgctggtggctaaggccagggcctctccaaccactgtgccactgacttgctgtgtgaccctgggcaagtcacttaactataaggtgcctcagttttccttctgttaaaatggggataataatactgacctacctcaaagggcagttttgaggcgtgactaatgctttttagaaagcattttgggatccttcagcacaggaattctcaagacctgagtattttttataataggaatgccaccatgaacttgatacgtccgtgtgcccagatgctgcattagtctatatggtctccaagaaactgaatgaatccattggagaagcggtggataactagccagacaaaatttgagaatacataaacaacgcattgcacggaaacatacagaggaagcctttctgggaatgggtgggatttttcccttttatgtggatatagaagtacctgtgacaagaataatttggaataa

SEQ ID NO: 16523 - DNA, 465 bp, Homo sapiens
gtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattc

SEQ ID NO: 16524 - DNA, 660 bp, Homo sapiens
cgaggcagccagcgcaggggcttctgctgagggggcaggcggagcttgaggaaactgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaaggcaatgcttttagattaaaatgaaggtgacttaaacagcttaaagtttaagtttaaaagttgtaggtgattaaaataatttgaaggcgatcttttaaaaagagattaaaccgaaggtgattaaaagaccttgaaatccatgacgcagggagaattgcgcatttaaagcctagtaacgcatttactaaaccagacgaaaatggaaagattaattgggagtggtaggatgaaacaatttggagaagaaagaagtttgaaggggaaactggaagacagaagtacgggaggcgaagaaaagaattgagaagatgggga

SEQ ID NO: 16525 - DNA, 248 bp, Homo sapiens
aagaaagaaaaggaagtcgcaaagagaaagtgatgtaatgcaaattgaggattttacaagatcagatactgctgctttaagtcaagggtgaataatctcaacaaacagcaaatagcaatcactttaccagctgcatattgcacccacataggtaactcttcattttaggaacaaactgaatttgaacactgagccttttgaactcagccatctctatatattctttccttaaaattcatgattttggc

SEQ ID NO: 16526 - DNA, 550 bp, Homo sapiens
gaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcggtagtataatatctttcctctttttcactgacatgttcatctactggattcacaggaggccttcatcatagactggtatataaggcgcctacataaacctcaccatatttggaagattcctactccatttgcaagtcatgcttttcaccctattgatggctttcttcagaggctaccttaccatatataccctttttatctttccattacacaaggtggtttatttaaggctgtaaaaatgaaaattattcaatgggagagggttacaaagactggaatagattatttgcccagttattcttaagggaagggcaaaagaggggaagtatcatccggatttccttttttttaagtaagggaaaaagtaagctccatac

SEQ ID NO: 16527 - DNA, 280 bp, Homo sapiens
  misc_feature 145, 146, 173, 175, 176, 181, 183, 187, 188, 189, 194, 196,199, 203, 209, 210, 211, 221, 222, 224, 225, 229, 231, 235,240, 241, 246, 247, 261, 265, 272, 274, 275, 276, 278: n = A,T,C or G
tcactcggctcgtgcgtcgatgaagaacgcagctagctgcgagaattaatgtgaattgcaggacacattgatcatcgacacttcgaacgcacttgcggccccgggttcctcccggggctaccgcctgtctgagcgtcgcttgccnnaaaaaaaaaaaaaaaaaaaaaaaatanannggggncncccnnnccccngncantttnaaaccnnnaaaacttttnncnngggncngaantgggnnccccnnggccaatccccccnaaanggggggngnnnancc

SEQ ID NO: 16528 - DNA, 154 bp, Homo sapiens
aacaagggaccaagcgcacacattgctgagagccgacttctgtgcctcccccgccccatccccggacttcgtgttgtgtctgccaggctcaggcagaggcgcctgtccctgcttcttttctgaccgggagataaatgcccctgaaggataaaac

SEQ ID NO: 16529 - DNA, 666 bp, Homo sapiens
aatcattagaaaaatgcaaatcagtgccacaatgagataccatctcacaccaatcagaatggctattattaaaaagtcaaaaaataacagatggctgtgaggttgtggaataagggagcacttatacactgcttgtgggaatgtcaattagtttagccattgtggaaagcagggtggcaatttcttaaagaatttaaaacagaattaccatttgactcagcaatcctattattggactgcttgtatatacccaaaggaatataaatcattgtaccataaagacacaagcattgtggaatactatacagccataaaaagaataagataatgtccttcacagtaacatgtatggagctgaaagtcattatcctaagcaaactaaagcagaacagaaaagtaaatactgcatgtcttaggtataagtgggagctaaacattgagaacacctggacacaaagacgaaaacaacagacactgaggcctacttgaggtggagggtggggaggaggggaaagattgaaaaactacctattgggactaggctgggaatgaaataatttgccaccaaacctctgggcatgcaattacctattaaccaacctacatatgtactggggaacctaaaaggaatggttaaaaatacccaaaacccctcaaaatgaatgg

SEQ ID NO: 16530 - DNA, 314 bp, Homo sapiens
agtaggaatatctgtaatttaagaatttataggccaggtgctttggctcactcctgtaatcccatcattttgggaggccgaggtgggcagatcacctgaggtcggcagttcgagaccagcctgatcaacatggagaaaccccgtctctaataaaaatacaaaattagccaggcatggtggcgcatgcctgtaatcccagttacttgggaggctgaggcaggagaatcgctttgaacccgggaagtggaggttgtggtaagccgagatcgcaccattgcactccagcctaggcaacaagagcgaaactccatctc

SEQ ID NO: 16531 - DNA, 574 bp, Homo sapiens
gtcttataaaaacctcacagccttccactaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctgctgcacccctttttcccgccccagattgataag

SEQ ID NO: 16532 - DNA, 610 bp, Homo sapiens
agcacagtaatcactggtggcagacactgtcatgatgcggatcacaggagatggcaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtcagtccaccttttgatacatgccatgcctttgatcaaagaacaggacataaaaacaaagtcacaatgacattccatagtaaatttggaatcagaactccaaatgcacttcgggctcgctggagacaactaaggggcaccaaaccctctgaggtttactttaagggtcgctgtatgttgcttgacaaaaaggctcctaccacgtgctatcaatatatcttaaataagccatactaaaactctggaggcagagctattttaggcttaagtagccaatgggccctcagctccg

SEQ ID NO: 16533 - DNA, 659 bp, Homo sapiens
tccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagttaaatataagaactggcctgaatctgtgtattttttcaagagaggtggcagcattcagcagtatatttataaacaggaacctgtacagaagtgccctggaagaaggcctgctctaaattatccagtgtatggagaaacgacacgggttaggagacgcgctttgaacgtgctataggaccttctcaaacacacaccatcagaattcaatattcacctgccagactgacttatcaagacaaaggtgccttcataatgaagttaaagtgagtatactgtggagaggacttccaaatgtgggtacctcagctatatcactgcccacatcagaaaacctgacggctatgattactatgcctttctaaagacaatctatacattgatgggccagtagaaagcaggacaattactctcgtctgggcagacctatccaaagcttgggccaactgcct

SEQ ID NO: 16534 - DNA, 296 bp, Homo sapiens
ggtctgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagat

SEQ ID NO: 16535 - DNA, 398 bp, Homo sapiens
gttaaataaatacctaccatactagaagtatgccattagctctgaaatttgaaattcaccatggtctgttttccccaactttggatgtgaaagcaggaaataaacaactgtgaattaaggctctaagtaactatgtagcagttgtagtttggggggtgggggaagactgccaacatgagataatcatggtggggttttctttccaatatgggatgctaaatagacatttgtgataactacataatcaacaacatctttaaatatttaatttcttgcaggtgttatcttaattgacttcaactcatatgtatgtatgtgtgtatgtattacatatatacatataactacatctgcagagggaagtgcaaattgaagtaattatgcggctcattctacaa

SEQ ID NO: 16536 - DNA, 297 bp, Homo sapiens
aaataaataaatctttagagcaaaaaacaaagttataggtattacacattctgatttcaaattatattacaaagctatagtaatcaaaacactgtggcactggcatgaaaacagagatgtaaagcaatgaaacagaatagagcccagaaataaacccaagcatataaaagtcaactaatttttgacaaggacatcaagaaaacacagtggagaaagaataatctcttcaataaatggtgttatgaaaattggatatccaacactggggagactggacccttatcttacatcatacac

SEQ ID NO: 16537 - DNA, 247 bp, Homo sapiens
gacttgctctccaattgtatccagtgattcgtttattaggaggtgctctgtagcagaaactgagctccgggtggctggttctcaggggtttgtctcatgtctctttttctgtcttaggatgtttcattaaatgcagcacttgttagcagatgtttaattttttttttaacaacattatcttgtggtctcttttctacacctgggaaatttactctagagttagataaaaactcatttgtctttggcg

SEQ ID NO: 16538 - DNA, 217 bp, Homo sapiens
gaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcaccg

SEQ ID NO: 16539 - DNA, 620 bp, Homo sapiens
gcggggagagggaaaatgtagggctcaggtatgcaactcttagacaataaaattattgtgtttcccgttttaattcttcgctatggtcagcgtattttactttttacagaaatcaggaactttagtttctttgaaaaaattttatacagggtaaggcacaatgttaacagtttaactctgtgtgtttgtaacagttctagaatggctttctgtattttgtaagtacatgctacagccaatgcaatcaccataatatacattgatcagcttgcattgaatatttccagacagggacactaagctatcattttccttagcatcaaaatttgcccttttaccagaaggtcatctaacagattttaaaagactttgtttcagatctcggagtcctgggtccttttaataattactttagtctcattggagctgggggttgaaaggtaaggcaatgaggatgattgcatcagaattcatgatctgggaggggacaaatggaaagcaagcctgatcaatcactgggaagggagggtaattggtaccgctctcaagcctctggcagataaccagtatgaaaacctattgccctgatatgtgaaagctaaaggatgaaccaatggaac

SEQ ID NO: 16540 - DNA, 286 bp, Homo sapiens
gggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaa

SEQ ID NO: 16541 - DNA, 488 bp, Homo sapiens
gaatgataagaaaaataggcactttgaaaattaatgaatgtgattaaaatatgtagttaggcaaagggtagtttaagaaactgcacagttatacaaggaagaaaatgggctgagagagtaagtaccctccatctgagattgcttgtgacatggccaagggccttcagtgtgccctgcatcctaagatgctgttggtggggcagagtgggaggacttagctccacctttgtttttcttcatgcaccaagctagggaagtcaattttgccttcaacacataggacttgatttcatcattatcatcagaaaaagttttatatacctttctgtgtattcaaaacatgaaaacaagaatcttaaatagctatagacattgccacccagatgttttgagttcaaagtaattaacaacatggtaggacacaataaacagagccatctttcagacaagtgcacagcctgatgagacagcagattaaaggcttaata

SEQ ID NO: 16542 - DNA, 327 bp, Homo sapiens
gccaacatggcggaacgcaggagacacgagaagcggatccataaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagtttttttcaccgagccctaaaagtaatgaaaatgaaatatgataaagacataaa

SEQ ID NO: 16543 - DNA, 506 bp, Homo sapiens
cccacaacaggccacatgtataacaatggccccagaaaattgttatagaactaaaaaatgccttttgcctagtgacatagtagctgttgtagggttgtaacacaacatgttattcacaagtttgtggtgatgctggtgtaagcaaacactgtgctgctggtcatttggaagtatagcacatacagttatgtacagtacataatacttgataataaacagctatgttactgatgtatatatttactatgccatcatttttatagttattttagagtatactcctacttattaaaacaaggtgactgtaaaacaacctcagcatatttttcagaagtattccagaagaaggcattgttatcataggagatcacagggggggtctcatagcccctgaagaccttccagtgagataaagatctgaggtgggagatggtggtattggaagattctggccccggtgtaagtccctgggggtttgtttcttaggggttgaacaaaaatggttt

SEQ ID NO: 16544 - DNA, 408 bp, Homo sapiens
gggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaagggggtttttgggaagacgttttctttatcgccctgagaagatctaccccagggagaatctgagacatcttgcctacttttctttattagctttct

SEQ ID NO: 16545 - DNA, 600 bp, Homo sapiens
aacactgttgctcttggtggacgggcccagaggaatttagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgctggccggtcctgaccagtgactcaccagccctcgtgggctcaaatataacatttgcggtgaacctgattttccctagatgccaaaaggaagatgcccatggcacatagctatgagaagaactgcagaaatgaggctggttatctgctgatccatatgtttacactggacagcatggccagaggacagtgacggggaaaatggcaccggccaaagccatcataacgcttccctgatgggaaacctttccccaccaccccggatggagaaaatggaattcatctacggc

SEQ ID NO: 16546 - DNA, 360 bp, Homo sapiens
gtgattatagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggt

SEQ ID NO: 16547 - DNA, 230 bp, Homo sapiens
atgtgaacagcagttgaacatgggtcagtcggtcctgagagatgggcgagcgccgttccgaagggacgggcgatggcctccgttgccctcggccgatcgaaagggagtcgggttcagatccccgaatccggagagacggaagtcaaggagtccgttcgcattcacgggacaagagaaaagacactcgagaaaagatcaaggaaaaggaaggagtgaaagagaaagacagg

SEQ ID NO: 16548 - DNA, 157 bp, Homo sapiens
ggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgac

SEQ ID NO: 16549 - DNA, 610 bp, Homo sapiens
aatagaaagtctaatatagcataatctagatgttatattggggggtagtgttcatatatctatctttactcattgaccgttactcaggagtggttaacatggaattcagaattgaagctagcattattaagccccctaaaatattaatgtaaagtttggcagtatgtatgttggtgcattttcttcagtaaaaccacgtatatttccttggattctcaaaagtataatattttcaatctaacaaaggataaaaatcactgccctgtaaccaaaccagcatggtactggtacaaaaatagacacatagaacaatggaagagaatagagaactcagaaataaaccacatacctacacggaactgatctttgaaaaacctgacaaaaacaagcaatagggaaaggatttcctatttaataaatggtgctgggagaactggctagtcatatgcagaaaattgaaactggatcccccttccttaaactttatacaaaagtaacgcaagatggattaaagatgtaaatgtaaaacccaaaactatagaaatcctagaagaaaatctaggcagtatcgtcaggacacaggcacaaataaagattcatgatgaaatgc

SEQ ID NO: 16550 - DNA, 532 bp, Homo sapiens
caaaattcagccaaattcttatggatatagtggtaatataaatttttggtttctctcctgaattgtttttcttttaatcgtctagaccagagctgaaggctgcttccccctcagagagaattgtttggcctaaaagagatttaaacagtttgtattagtttccatcataggggattcagaagataaaatctgacttttccctgctacctcctttaataagggcatatatcaccagaactctaccttgcctcctctatcctgtcttccctcatacatgctatgtttactttgcctcccctggctcctataggcatttgagtttgttgtcttttcttgaatgattaaatgagatatttgcttagtgattatttgacttaataaaccattgtgagaaattgaaggtcactgggcactggcttttagaatctggatttacactgagactgagggacaaagactgcacaacaaactgaatttatgtgcattggacatttgcattttctggatggtaaataggaattgcctgctgggc

SEQ ID NO: 16551 - DNA, 354 bp, Homo sapiens
cctagcctttctattagctcctagtaagatttcacatgcaagcatccccattccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccggggtcacacgattaacccaagtcaatagaagccggcgtaaagagtgttttaagatcaccccctccccaataaagctaaaactcacctggagttgtaaaaaactccagttgacac

SEQ ID NO: 16552 - DNA, 526 bp, Homo sapiens
cagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtattttt

SEQ ID NO: 16553 - DNA, 488 bp, Homo sapiens
atgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattcc

SEQ ID NO: 16554 - DNA, 445 bp, Homo sapiens
agtggccaggaaaagtacaacctgagtccccagcctttaggtaaagtctttgtgaccttataatcaataggtctgcaactgtagtgctaaatgacttcccgtaatttgaagatggtgctccagatggcagtagtgtgctcagtcacatgctcaaaacgaatgctgggaaccacagcatgttgctgctttaggaaagatgggacactggctcagacccagacactgacttagggaaaatcattcacaggggtgaatattttacacatgaaatttcatttgggtctcacaacagccctatggacgggttattatcccccattttaccaaccagggaactaagctcagggaaggttagattcagagaggcgcagagaattttaactcagatctggctgctcttaaaacacgcctaaacatctctttcatcaaaaaataactcattgtg

SEQ ID NO: 16555 - DNA, 562 bp, Homo sapiens
caatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaa

SEQ ID NO: 16556 - DNA, 177 bp, Homo sapiens
gaagtgcccctagggtgatacgtagggcgagaaagggcctggtccgcgccagacccagcgcgcctcgtcgccatgcctcggaaaattgaggaaatcaaggacttcctgctcacagcccgacgaaaggatgccaaatctgtcaagatcaagaaaaataaggacaacgtgaaggtttgg

SEQ ID NO: 16557 - DNA, 243 bp, Homo sapiens
gccgagtcttgtcatatgatttggctttctccgctcatagctgcttttggcgctaaagatgccttttctgttttgactcaaaccctgccccgcctgagtctcagttttaagatccgttttaatcccttctgcgcttgcccgtgagacctatatgtgcgcgcctattcttggtttcgtgtgtcgtgtctctgttagactgatcccgtagcttattaccgggagaacgatggttagagaggagaa

SEQ ID NO: 16558 - DNA, 504 bp, Homo sapiens
gacgcggtcgtaagggctgaggatttttggtccgcactctcctgctcctgactcaccgctgatcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttgagcagattacttccatcagtattgagccaggagttgaggtggaagtcaccattgcagatgcttaagtcaactattttaataaattgatgaccagttgt

SEQ ID NO: 16559 - DNA, 448 bp, Homo sapiens
aggcgggaggacatatgaatgaaaataaggtggaccgtttaatcatagcactgccctgaatgttcttattctctaaacatcatcagaggctgaggcagtcatgagcatttgaggtcagggagtttgagaccatcctgaccatacatgttgaaaccctggctctactaaatataaaaagtgaccaggcattggggggtcacctagagatctcaagcttcttggtagggcctgaagcagtggaattgcttgaaacctgggagcagaggggcagggagccatagatcacacctgtgccctgcgtgggtgagcgacaggagtgagactccctgttaaaataaataaagaaccatcatgcggagatggtcttgaagcaggaaagaacatgacttacatgcatatcactgatccttacttggaaagagacttggtttattctagagactgggaa

SEQ ID NO: 16560 - DNA, 102 bp, Homo sapiens
aattccagcacttcgggaggccgaggagatcgaatcacgaggacaggagctctagagaccagcctggccaacatggtgaaaacccgtctgtacgaaaaatac

SEQ ID NO: 16561 - DNA, 152 bp, Homo sapiens
cgcacagcttatattggttgcagatgctgccataaacctgcacgtgcagggatccagtttcacaaaagaagcctacaagaagtacatcaaagattacaaaaataaaatgcatttaaactcaaaaaaaaaaaaaaaaaaaaaaaaaaaaaaaa

SEQ ID NO: 16562 - DNA, 300 bp, Homo sapiens
gttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaactt

SEQ ID NO: 16563 - DNA, 461 bp, Homo sapiens
gaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggcttgtgaagtaaaactttttatatttagagctccatttcagatttcttctttgccacccttttaaggactttgaatttttctttgctttgaagacattgtgagactgtaatttttttttttggagaaaatgggaattttttgggcctctaattggtggttgccctgggac

SEQ ID NO: 16564 - DNA, 174 bp, Homo sapiens
cagtgggccattttaagagttacttaatgtttggtaacttttatgccttcactttacaaattcaagccttagataaaagaaccgagcaattatctgctaaaaagtccttgatttagcactatttacatacaggccatactttacaaagtatttgctgaatggggaccttttgag

SEQ ID NO: 16565 - DNA, 474 bp, Homo sapiens
gaaaggtgtaaatatcaataacagtgctacttagttatcagtatttaatatctgaggtgagttgggggtatctatattagggggagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagttcgaagaataaaatatgagagcaatatttaaattctcaggaattgacttacactcttgagaatgaattcaggttcaatcaaagtttacattatggtgcttaaaaaaaaagaaattattcttatcttgc

SEQ ID NO: 16566 - DNA, 450 bp, Homo sapiens
catataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcaggttatttctgactagggatattttcttccatttagaaaagaag

SEQ ID NO: 16567 - DNA, 466 bp, Homo sapiens
tcaatctgagaacaacagcattcatttccattcatttccatactggcttttgattatatgcagattcctaggagcatgccttacctacagcactatgtgcatttgctgtcacaataaagtatattttgtcttgcattgatgcagtactgctgcttattttccactgatcttgtctagtgatcatcttaatttttatctctgaacacatacttggtatctttgagtacctgtagctttcttcatttggcaatgatagtgatgctgacttgattaactgcctaattcacacatgaagacattgactttgccagtattaacttctctgagatcattttgccttagatctgataactatagtcagtatatataaacaaaaaaatttcatattactagggtaacttttaggaactggcaggaccagcagcaagctcctctggccttttaaaaacttccatttgcaaaaaaa

SEQ ID NO: 16568 - DNA, 373 bp, Homo sapiens
gagcctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactg

SEQ ID NO: 16569 - DNA, 291 bp, Homo sapiens
atgtgaaaggtgacttcactagttacctgcttgagcagagtaaagtgtgtacatgtacataaaatgtaagtaatcttaactccaaagtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaggt

SEQ ID NO: 16570 - DNA, 351 bp, Homo sapiens
tcttctaggtgtgttcagtgctaaagacagtattgtttccttggacataaatagtcttagtgcggtggctttctcaaatgccagttttagtagcagcaacctcctgagtagccagggtggtataggcaatgattgtaagaagcttatcttgttcccaagtgctctatagttgtgtaagcaaatgctgtaatggactgtgcactccactctctaggccagtaagtaggtgacacttgcaggtaagacccatctgcagtggtagcagtttacaataattgaggaggtgagaattcttcctaactcattctatgaagccagtatcatgctgataccaaaaacatataaggacac

SEQ ID NO: 16571 - DNA, 660 bp, Homo sapiens
aacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgcctttagaaaagacagctaaaaccttgttgtggattatggatttagcctaaagaaaaataatctggcataaattaagagtaagagagaagattaatagaaatttcacttcacataacttaaaacatggctatttcaataaagggactaaaggttctcctggatcccagaattcaacctgtatttataaatgataatgtattagctcttttgggttaaatgaactggtggggtaagctggaaatgtataattttaactatttctacaaagaaaatatttctaattaagtggagctatctgtgcagcagttctctacagtgggcataaatgttttactataaaaagagctaatggataaaaaccgctggttccataataaagatgga

SEQ ID NO: 16572 - DNA, 514 bp, Homo sapiens
tcattattcattattgattgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcccggactgtgactttcagtgggagatggaagtttttcagagaactgaactgtggaaaaatgacctttccttaacttgaagctacttttaaaatttgagggtctggaccaaaagaagaggaatatcaggttgaactcaagatgacagataaggtgagagtaatgactaactccaaagatggctcactgaagaaaaggcattttaagattttttaaaaatcttgtcagaagatcccagaaaagtctaatttcattagcaattaataaaagctatacatgcagaaatgaat

SEQ ID NO: 16573 - DNA, 390 bp, Homo sapiens
agcaaagactcagctgtaatcttagcatactctcaatctataagaggggaccgttttgaatcaaaagaagaatttatatatattggaaatgggtaaaagggaacacattgaacttaattgaaaatttctccatactggcctttagttttttccagttttaccacaaacgcagtgaatacttgttctacacaagtggtgcagaggcaaagggctgatcaacagccttgtttgaactggtctcttcaccaaatggccagaggaaattaagctctgatgacaaagggctataaacctgaggagacagtctaattctatcacaaagttccactgtcactctgcacagggtaggaattggggatcaggttagtcttgattgagcagctttattac

SEQ ID NO: 16574 - DNA, 399 bp, Homo sapiens
atagaaattgaaacctggcgcaatagatatagtaccgcatgggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaagcctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 16575 - DNA, 463 bp, Homo sapiens
atatgtaatattttcagttcaatgtaagccaatatggtccaccagatatgtgaggaaagcctaattaaactaatgatgtaaataatgcttctaaggtagaattaataggatgtggtaacccataaatgtgtggggagtgtagggaggaaaagagaatgaaacatttgccttaggagactaggtgtattgtctaactatgcactgcagatgttttcagcaaccctttgtagagaatagagcagtataccttgctcagtcaggcttcgaaaatcctactgactgtccatcagtcaccttttgcccttaagagcaatgattcaaattaaaaccctgaacaagaaaatgaccacaggtaaatccagttaattgtagattaaacctagattcttcatccagtttctgtctctattcaaggtttgtatgcaatcacacaagtttcaaagacttcaacagtttgcattag

SEQ ID NO: 16576 - DNA, 410 bp, Homo sapiens
ataggtacagagtgactagaatgatatttgatagaaataaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgattcattgaataaaattctctgacttc

SEQ ID NO: 16577 - DNA, 181 bp, Homo sapiens
gtgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagc

SEQ ID NO: 16578 - DNA, 568 bp, Homo sapiens
aagggcagaaagatctacttttcaatgatctgtattttaagatattgacttttcctggtgctattttatgattatggagaaaatagaattcttattagaaatctcaactccgaattaagagtagatgttttgatacttgtcctgctgtggcctgagacttggaatcatgaattaaaagagaccttgctgtttatctacagattagaacacacaaataaacatcagtgtaacatcctcattagcattctggtagttacatgtacttattccagagcaaaattaatatatgataagaagtggaatattttctgttgttatctaggatattaagacaacaaccttccttagaaaagaaacagcgtattatgaggacagtggatgctacaacgttatttgccttcaaggcattgcaaacaactggaatcaattgtataaccttctcaagcacaagccaacagtgaaatgagagtcatttatctgaaacagcaggcaagagcttcattggtacactcggaaggtggctcactaaccctgccgaagtttgcttcatctgatcagggcataaatg

SEQ ID NO: 16579 - DNA, 200 bp, Homo sapiens
aaaaccaggataaattctgcaatttattaccttctcgttttggaattattactaggactgtgatagaagtgcgaaatagaataaccttgttgacaccttcatttgggagtttgaagagtgtgtcaggagaagtgattgaacaattcgggaagcctgtgtgtgatgtttaactagagaagagtgtctctagtcttactcca

SEQ ID NO: 16580 - DNA, 343 bp, Homo sapiens
gaaatccggcatgttcttgtcacactgggtgagaagattacagaggaagaagtagggatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgccttttccctgtgtgaattttgtatctagcctaaagtttccctaggctttcttgctcagcaactttcccatcttgctctcttggatgatgtttgccgcagcattcaccaaataaacttgctctctgggaaaaaa

SEQ ID NO: 16581 - DNA, 438 bp, Homo sapiens
gaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattatttttatactgtatgtgccaaagctttactactgtggaaagacactg

SEQ ID NO: 16582 - DNA, 517 bp, Homo sapiens
aggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcatgatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgcactgaaaacattttattaataaagaatattgacatgaatt

SEQ ID NO: 16583 - DNA, 192 bp, Homo sapiens
gtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcattgtttaaaaaaaaaaaaaaaaaaaaaaaaaa

SEQ ID NO: 16584 - DNA, 366 bp, Homo sapiens
ttgagtaaggattaagtaaaactacagctttcttctcaaggaacttacatcaagcagaggaaatgagacttaaatataataatcaggactgggcatggccggctcatgcctataatcctagcactttgggaggctaaggtgggtgaattgctggagctcaggagttgagactagcctgggcaacatggtgaaactccatctctacaaaaaatacaaaaaattagccaggcgtggtggtgcaggcctgtagtcccagctacttggggaagctgaggggggaggacatttgtgccaaaaggcaagctacagggagcggaaacggcgcattgacacttcagcccggaagacaaagggagacccttaccg

SEQ ID NO: 16585 - DNA, 153 bp, Homo sapiens
ggcagtgtcctaggccctgatgcataaaattggatgtgaaattaagaaaagttgaataagaatatctaaaaggaggagctagttaaacgaccatctgtaagaaaaataaaatgagatcaaaagggttaaaaaaaaaaaaaaaaaaaaaaaaaa

SEQ ID NO: 16586 - DNA, 408 bp, Homo sapiens
tgctgggaatgaatggtgtatcaatgtatgaatgtgtacaatgagatctagaaatatagtgatggcaagcagacccatggtggaattagaaccttcatcactttttctttaattctttacagggctcacaagagaccacactcaaggagtgatgaacaaattttaattggtaacataattctagtaatactaagtgttgaggagtttctgactgaatccctacttctctgatgttgaaggtgttgtaaggcaaagggtcaataaatcaatttagtgacatcctataatgcccaggctttcattggctaaccttggcatttattggtactccaattgaaaaaaaaaagaaacctgacaaattcacagaatatagagaaaaatgttgaaggatacaagccaaaaaaaaaa

SEQ ID NO: 16587 - DNA, 465 bp, Homo sapiens
caatagatatagtaccgcaagggaaagatgaaaaattatatccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagcaccaattaagaaagcgtcaagctcaacacccactacctaaaaaatcccc

SEQ ID NO: 16588 - DNA, 581 bp, Homo sapiens
ttctcagagataccatcagagaacaaacacttatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggggtttctcataaatgagggctgcacattgcctgttctgcttcgaagtattcaataccgctcagtatgttaaatgaagtgattctaagatttggtttgggatcaataggaaggcatatgcagccaaccaagatgcaaatgttttgaaatgatgtggcccaaaatttttaaggtagggaagtcacccaaacacttctggtttcacttaagtgtctgggccgcaattctggtaggaaccaagcattgatcttggttactggggatattttaaaattccccaggtgctcactttttt

SEQ ID NO: 16589 - DNA, 196 bp, Homo sapiens
gcttatcattacttgcatctgagtgaaaaaagaaaaaaggtcattatttagtgcacacatgaactgattttcaacaagcatgaacagagcagtttaagcggcgaaagaatagactttccaacagaaacagagatccatgtactagaacaattaaatatccaagtacaagaaaaaaaccttcaatatctcataccag

SEQ ID NO: 16590 - DNA, 521 bp, Homo sapiens
caataaattaggtattgatgggacgtatctcaaaataataagagctatctatgacaaacccacagccaatatcatactgaatgggcaaaaactggaagcattccctttgaaaactggcacaagacagagggatgccctctctcaccactcctactcaacatagtgttagaagttctggccaggacagtcaggcaggagaaagaaataaagggtattcaattaggaaaacaggaaatcaaattgtctttgtttccagatgacatgattgtatatctagaaaaccccatcgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatctaggaatccaacatacaagggacgtgaaggacctcttcaaggagaactacaaaccactgcttaacg

SEQ ID NO: 16591 - DNA, 153 bp, Homo sapiens
gttctaaaaattttcttaagttgtttgcttggaactcagagtatatttttccatacgaaaaattcagaactattttatttatgatatgggctaaaaagacttctgtaatctagcttggaaacttaataatcattaaacttattttcaatgacc

SEQ ID NO: 16592 - DNA, 275 bp, Homo sapiens
aagtgactatttgctagaaattcaacttgctccttcctgtcatgcggaacgggggattgtctagattcgagctctttcttccctgatgaggagtatcactggagcccttaggtataggagaagaggacgacgtttaaaaagtgtaagtgggccgggcgtggtggctcatgcctgtattcccagcgctttgggaggcccgaggggggcggatcacgaggcaggagatccagactatcctggctaacaaggtgaaccccgtctctaccaggaataca

SEQ ID NO: 16593 - DNA, 530 bp, Homo sapiens
gaggtgccttaggccgcttgccttgctctcagaatcgctgccgccatggctagtcagtctcaggggattcagcagctgctgcaggccgagaagcgggcagccgagaaggtgtcccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtcc

SEQ ID NO: 16594 - DNA, 463 bp, Homo sapiens
attgactgttaattaattagtacctttgtaatggtataatttagagaactgcattttagggcattactttagtctcaaggttgtcaaatattgtaacttgagctttgaaaactagtttgtaaaaatgagggaatacatttaatccatgtcaactaatttgaatcaatgacataaaatacagcttgggcattaaagcaccgtgtatatgtttgcgtgtgcttgtctaactgggactgtctatgtcaatcttctgttaccttatgcgttgtttggtttatctagctttttaaaaaattggttatagtcttacttcatgcatttttagcacaaatcttcatttcattttaccttcacccagtaataagagcagaaaaagaggtcagcgacaaataatttgctgctcattagttgagttgatgtgtgggaagtatagcacttttgattgaaatggtggttgtcggcc

SEQ ID NO: 16595 - DNA, 318 bp, Homo sapiens
cgcgcactacactactgcctgagcaacagagtgagaccctgactcttaaagaaaaaaaaagtcagactgctgggactggccaggtttctgcccacattggacccacatgaggacatgatggagcgcacccgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttt

SEQ ID NO: 16596 - DNA, 532 bp, Homo sapiens
  misc_feature 5, 8, 13, 14, 15, 21, 24, 26, 27, 32, 33, 41, 43, 50: n = A,T,C or G
gaggnggnagggnnnaagaanccnanngaggnnctcggctnanggggaanggaccccggggaagtaagatgcatgcaagaagtggacagagagaaattcataatttaaaaaaattaaaaaaacgcaacagcgcaacttttcttaataccatataccttttaaaacacagtggcaggtaataagtggaagagaagaatgtttctggctgttcctacggcgactgtgcttattccactggtttctttagcaggactgttctactcagcctctgggaagaaaacttcccacagggctgcactagcacagccagcctttgcttttacagcctgctcttgcctattaccataccagtgtatgtattcttccacctttggacttggatgggtattaaactcttcaggcataattgatgcaactagagtcaatatgctgtatatataaatgaccgctcttggcatcgatctcttgaagctcaaatggatgggaatttagtttgcgggaaagaggcttggcttggcgcatatcaggctta

SEQ ID NO: 16597 - DNA, 263 bp, Homo sapiens
aatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaacccgg

SEQ ID NO: 16598 - DNA, 569 bp, Homo sapiens
agcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtatttttaaagctattaacaagcaatatattaaaataataatgtattatatctgtttctgacccagtctatgtacaatattgctggtgagccctctcccttcagtgtgtcactgttcactttggagggttactttaggaagaggataagtgttaccacaggggaaaaaaatgcagaagaggatgcatcagaagaaatggcatgacaatgttttctcttagtgtcttttaaatactaatagctcctgaataagacctgcagcatcctttagctaaggtgatgagaaatccatgttaccgatatagaagccaaactctaagccaaggatcacataaagagaagaaaaag

SEQ ID NO: 16599 - DNA, 307 bp, Homo sapiens
gaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattc

SEQ ID NO: 16600 - DNA, 472 bp, Homo sapiens
gaaaatagattaaaaagaataaaaagagcctctgtgtcttatgggacaatatcaaatggtcttacatatgtataattatatacatgttacggaaagataaacagagataatgatgcaaaagagagtgttagtagaaatagtggctaaaattttccccaaatttagtaaaaaataaatttacagattctaacacctcagctactctcaaacagcataaatacaaagagaacaacacctaaatgttttatattctactataaaccaattataaagagaaaatcttgaaagcaaccagagaaaaatgacacattagatagagggggagcaataatacagatgatggcctatttcttatcagaaataatggagaccagaagacagtgggagaaaatcttcagcgtgctgaaagaaaaaaaatctgtcaaccccagaattcaataatcagcagaaataattttcaagagtggaaggc

SEQ ID NO: 16601 - DNA, 508 bp, Homo sapiens
cgaaatgaaacacaagaaattggccactggaagttactctgcagctccaactgtgcttcatttaatgccattaatgcaaatatacttcctcttctttttgcatggatttgcccacctctgcaatagtgataatctgatgctgaagatcaaataaccaatataaagcatatttcttggccttgctccacaggacataggcaagccttgatcatagttcatacatataaatggtgggaaataaagaaataaaacacaatacttttacttgaaatgtaaataacttatttatttctttgctaaatttggaattctagtgcacattcaaagttaagctattaaatatagggggatcatagttcctctaccaagtctggaaagaacatctcctggtatccacaattacaccaggttgctaactgtatttgtacatttccctttgcattcgcttttggtcttgctagaaacccagtgtagcccagggcagatgtcaataaatgcatactccgaa

SEQ ID NO: 16602 - DNA, 286 bp, Homo sapiens
caacgaggcagccagcgcaggggcttatgctgagggggcaggcggagcttgaggaaaccgcagataagtttttttctctttgaaagatagagattaatacaactacttaaaaaatatagtcaataggttactaagatattgcttagcgttaagtttttaacgtaatttcaatagcttaagattttaagagaaaatatgaagacttagaagagtagcatgaggaaggaaaagataaaaggtttctaaaacatgacggaggttgagatgaagcttcttcatggcgtct

SEQ ID NO: 16603 - DNA, 488 bp, Homo sapiens
tgattaaatgcctcttaactacttcagattcctggattgatgtcttatctacaggcttctttttaaaaatcaagaatgattggctgtgagtttaccaggattatagttgaggctaaaggacagctcctcaggaaagcccctgttctacatctacggtcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggcatgaggaacagttgtaaagtttccaggtctacaataactttctggaaccctctcagtgaactgtttcttgtaaaagtttccctaagataaaagctcaatcccattgtt

SEQ ID NO: 16604 - DNA, 498 bp, Homo sapiens
gaaaatcttataagtgtgtttctttcccacttttgcaatataatttttctcttctaccctcaactgaaataaggtcacacagcctatacagtatagagccaggactccaaggtcactgacaacaaagtaaaagtcagcagttttggaaaatacatattttttttttcctagctgaggatgggttaccttcattagtgacataactatgtcacttgaatatcaattattggcttgaatatcaattcatttctctattaagaaaaagaggaaataactcagatataaatgatggaagtggctactgagttaggaaaacatttgaaaatcactttataccaagaaatcacattctggcaggcctaatatggtataggagatattcgtaactggttatcttcattgaaagattatagagactagagaataggaaggttaagtaaaaactctacaaatgataaaattttatgttaacaagtaacctaaccaaatactgtattt

SEQ ID NO: 16605 - DNA, 475 bp, Homo sapiens
caaaatattcaaataattctcctatgaagctagtgagatttgattggaggtaagccctctgcctggccaacactacaggtagacttagaggagttggcttttatcttagagttaggagtaggtatctcactgttggcaaatgctcagatccctaatagaacctcttttttggcttcgctcttgatgttactgtgatgtcttgtaattatgtatattctacaaattatattttcttttatcagcacagttttctgtacttccagaaatgttaccactttgggttcaacgatatcgcctggagcactatactgggacatcgaattggctggcattaggaactgtcttcctgttgggctctggcattttctcgctctgtggcactgtcaaaggaaatcacgggcccttgatttgtatccagaatttaccgaatgctacagaccaaccatcccactgtcccaaaaggcagacctgggaa

SEQ ID NO: 16606 - DNA, 235 bp, Homo sapiens
gcattttatttccaggtagaggtaagaacattttaagttattgttctccataagaatataagaggggaaatagtgataatattgtaaagtgataaatttgaataggaattgggccatattttccagtattcagcattatacatttttctctaaaaattagtgtttattggttgcacttcctttgatttttcttagtgataaattggaccttagggaacagtccaggcttatggga

SEQ ID NO: 16607 - DNA, 387 bp, Homo sapiens
aaagatatgcaagaactgtacaggttgctttgatctacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgcttttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgtttataatgcaggtgt

SEQ ID NO: 16608 - DNA, 493 bp, Homo sapiens
atcgagtttctgtaggcgcctcactggggcatgacattgctaaacatctcacatatgagaatgtaggagcgatggccgaaagaactgagagatcatgctgagaggaacattgtgtatcatgcttgtgggccataagagtgatctacgccatctcagggcagctcctacagatgaagcaagagctgttgcagaaaagaatgggttgcactcattgaaacttcggcctagactctacaaatgtagacgctgcttctcagacaattctaacagagatctaccgcattgtttctcagaagcaaatgtcagacagacgcgaaaatgacatgtctccaaacaacaatgtggttcctattcatgttccaccaaccactgaaaacaagccaaaggtgcagtgctgcagaacatctaaggcatttctcttctcccctagaagctgtgtatagccatttcccagggctgagattaaatatatttggaatcctggggcactttt

SEQ ID NO: 16609 - DNA, 550 bp, Homo sapiens
tgttgttctgcaaaaaaccttcgagatattgatgaagtctcatctctacttcgtacctccatgatgagtaaacaatatggtaatgaagtatttctggccaagcttattgctcaggcatgcgtatctatttttcctgattccggccatttcaatgttgataacatcagagtttgtaaaattctgggctctggtatcagttcctcttcagtattgcacggcatggtttttaagaaggaaaccgaaggtgatgtaacatctgcaaagatgcaaaaatagcagtgtactcttgccttttgatggcatgataacagaaactaagggaacagtgttgataaagactgctgaagaattgatgaattttaagtaagggagaagaaaacctcatggatgcacaagtcaaagctattgctgatctggggcaaatgtcgaagtaacaggtggcaaagtgcagacatggctctcattatgcaaataaatataatatcatggtagggaggccaactcaaaatgggatccccgaagacttggaaaacggtggggcacagctctt

SEQ ID NO: 16610 - DNA, 415 bp, Homo sapiens
atatgagacagacagttgcggtgggtgtcatcaaagcagtggttaagaaggctgctggagctggcaaggtcaccaagtctgcccagaaagctcagaaggctaaatgaatattatccctaatacctaccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgccaaaaatttgtcacagaattttgagacccattaaaaaagtaaatgacaaaaaaaaaaaaaaaaaa

SEQ ID NO: 16611 - DNA, 595 bp, Homo sapiens
ggagcatcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgt

SEQ ID NO: 16612 - DNA, 470 bp, Homo sapiens
gaagaaggaaattgaaaaatttcttgaaacaataatggtttggataatgaaaacacaatataccaaaacctgtggaatacagccaaagcagtattaaaagggaagttaacagctataatcatctacatcaataaagttaaaaaaaatcaaagaatataatgatgcttattcaaaaactagaaaagcaagagcaaaccaatcccaaaattagtagaagaaaaaaaataataaagatcacagcagaaataaatgaaattgaaacaaatgaaataatagaaaatattagtgaaatgaaaagtttgttttgttaaaaaagataaagaagatttacaaacctttagatagactaagaaaaaaaagagaagactcaactaataaaatcagagatgagaaaggagacatcacaactgaaaccatagaaactcaaaggatcattagagacttctatgaacaactctatgccaaaaaaa

SEQ ID NO: 16613 - DNA, 329 bp, Homo sapiens
ggccagaagacctcccgtcaggtgccgggcgccggatctgtgtgggccctgctggtcgcggctaccaagaggcgggcaggcctgaaagacgcacgacatggtgcgaatgcacctccaggctgcaacactgcctcaggatggcggccttgcattccgagcagagctgcacaaaatcagaccttgtgccccctcggagagaccattggcatgccacaggggactctcctccttcatcccgtgaaggcaacaataaaaaccaaattatggggctgctctgcacactagcatagagaatgggggggaacgtaacttggaagcctgccggggcg

SEQ ID NO: 16614 - DNA, 218 bp, Homo sapiens
ttccggcgtcgccggagtgaattgatccgggagttgaagagggctgcaaggtgggaagtgaagtcagtgcctcaggtgctgctttctcctctaaatcttggtctcttgtttggaagtgactaacagcattttggcatgagaaagccctaaaaagatcagtgtgttttttgtgtccaattcttttatcaccaaaaaaaaaaaaaaaaaaaaaaaaaaaa

SEQ ID NO: 16615 - DNA, 482 bp, Homo sapiens
ggtcctggcagtgtctgaataaattggacaagttagagaaaatcttgaacctgaaagctactttgtctttcagcttggtttgggcaaggtaggaagagatgaatcagttataatttgatgggatctaatgttacttttataagatacatcactttaatatgatgcttcatcattaatgttttagtaatctgacagcattagacagaattgatattccccttattttattatttcttggcttcatgacagaactgtgcattaaaaggcacttaagattttaaaagggatatctaagaaagtggttaaaaaacaaacaaatcccaagtggcttgatctgacttacaaactctaacaatgtgtagctaattgcagatagattttattattcacagtattgtgtcaagtctcctgtgcacatcttctgtattggagcataagtaatggagatgttatcttgcccaacattagggttgaggaagtcg

SEQ ID NO: 16616 - DNA, 189 bp, Homo sapiens
  misc_feature 36: n = A,T,C or G
cagctggagatttgatgtgcagctcaaagatctaanaagatggcagaatcatctgctcctgtcccagcagctggcctgcattgtgctgacctcagctggcatcatggaccacaaagagatgagatgaaaacacacaggaggaaaaagcctgggattctttttctaggggtgtaatacacccatgaaaaa

SEQ ID NO: 16617 - DNA, 436 bp, Homo sapiens
tactcggatgcagagcgacataattttcagtatgaccatatttctaatccaacgagccaaactttttttctctgcagattgaatcataggaacttcttttcacaacaatgtttgctgttataatgtgatgttaatggtactaattagccctgcagaacccctatgacatcctttggcatcgtctcccatcgtctctctctctttctctctctctctcattttaataataactggtgtataaaaattgcatgaggaataagttcccaactcccgggatctgcttataatagctgtactttcttcatatagtcttaagaggcatgctagtttaagcaccttccagagaaggtgtgtatttatgcaaaactttccaggggcttgttaaaagtgaagcttttgcatgatttgtataagagagtaatgaggatatctatct

SEQ ID NO: 16618 - DNA, 388 bp, Homo sapiens
gaagcccactcttgattgcacccaccctgtagaagatggaatcatggatgctgccaattttgagcagttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaa

SEQ ID NO: 16619 - DNA, 421 bp, Homo sapiens
gttaatgctcaatgactgtttttttaaaaacccaatattcctctgattagcaacccattaatacactatttaaacatataaatacacacttgagaggtccagctggcttttctgataggctgggagacattctgttggcatgtacttattgaatcaggcaaaacctcaagactctagctagagccattcaactccgcttcactgtgaccattttcttatgtatccttccagaaatattatatctctatagatcttcttttctccataaatgatagcatactactaaatactctgagcattgtttttctttttttgttaacattatatatttgagattgttttatattaatgaatgttaacttaccttatgtatcttgacagttccagagaattccattgtttggatgaataacaatttagg

SEQ ID NO: 16620 - DNA, 564 bp, Homo sapiens
gactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgtcaagctcaacacccactacctaaaaaatcccaaacatataactgaactcctcacacccaattggccaatctatcaccctatagaagaactaatggtagtataagtaacatgaaaacattctcctctgcataagcctgcgcagattaaaacactgactgacaattaacagccaattctacaatcaacccac

SEQ ID NO: 16621 - DNA, 534 bp, Homo sapiens
atttaagaagcatcctctgccaagaccaaaaggaaagaataaaaagggccaaaagccaaaatgaaactgacggtacttgttttcaccattgggccaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgtaaacaagtagtaataaaagtaatcaatcgaaaa

SEQ ID NO: 16622 - DNA, 378 bp, Homo sapiens
cacataggtaggaatctttatagatgaagactatggaatgtcagagatcagccaaacagtatgatggaacagtgaaagtcaattcagcgagggcaacactgaaggaacagttaccctgcgttgccgcgaaagggtcatcaaattgtaatgttagaattaactctgtaaaagtgtctgtaggtacgttttatattatataaggacagaccaaaaatcaacctatcaaagcttcaaaaactttgggaaagggtgggattaagtacaagcacatttggcttacagtaaatgaactgattttattaactgcttttgcccatataaaatgctgatatttactggaaacctagccagcttcacgattatgactaaagtaccaga

SEQ ID NO: 16623 - DNA, 586 bp, Homo sapiens
ggagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttgggttactgtaatagtgtgctgttcatggaaaccgagggctgcatcttgtttatagtcatctttgtactgtaatttgatgtacacaacattaaaagtactgacacccc

SEQ ID NO: 16624 - DNA, 321 bp, Homo sapiens
aacttacaagaattaaaaagttgataggcacctggccgggcgtggtggctcatgcctgtaatcctagcactttgggaagccaaagcaggcagatcacttgaggtcaggagttcaaaaccagcctggccaacatggtgaaaccccgtctctattaaaaatacaaaaaaaaaaaattagccaggcatggtgacaggtgcctgtaatcccagctacttgggaggctgaggcaggagactcgcttgggcctgggaggtggagattgcagtgagccaagatcatgccactgcactccagcctgggtgacagagtgggacttcatcc

SEQ ID NO: 16625 - DNA, 560 bp, Homo sapiens
tcttagagatctatgaagagacttagactcccacacaacaatagcgggagactttaacacctcactgtcaatattagacggatcaacaagacagaaaattaacaaggatattcaggacttgaactcagctctggaccaagtgaatctaatagacatctacagaactctccaccccaaatcaacagaatatacattattctcagcacctcgtcgcacttattctaaaattgaccatataattggaagtaaaacattccttagcaaatgcaaaagaatgggaagcataataaactgtctctcagaccacagtgcaatcaaattagaactcaggattaagaaactcacttaaaaccgcacaactacatggaaactgacaacctgctcccaaatgactactgggtaaataatgaaatgaaggcagaaataaagatgtctttgaaaccaatgagaacacaacacattgtccagaatctctgggcacatttaaagcagtgtgtagagggaaatgtatagcactaaatgcccccaagggaaagcagaaaagatctaaaatggcaccc

SEQ ID NO: 16626 - DNA, 270 bp, Homo sapiens
attctatattcagtgaaattatccttaatatagaatgaagtagaaataaggattttttcaaacagaaaaatgaaggagttcattaccagcagacctgccctgcaagaaattttaaaagaagttctttgggaaagaagggaaataatgtaggtcagaaacttagatctacgtaaagaaagagcatagagaataaatgaatgaaggtaaaaacacaatatttcattttccttatttttaattgatctaaaaaaaaaaaaaaaaaaaaaaaaa

SEQ ID NO: 16627 - DNA, 507 bp, Homo sapiens
gaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgtttcatgaataaatattgtcagccagaaaaggttggtgtc

SEQ ID NO: 16628 - DNA, 556 bp, Homo sapiens
gcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggtatggcaaaatcaataagaagcgaattgctttgacagatacgctttgattgctcgatctct

SEQ ID NO: 16629 - DNA, 348 bp, Homo sapiens
ccacagaatgatcaagttgacgacaggttaggaagccgcactcagttatggcttctacggctgccactgtggcgtgggtggcagaggatcccccaaggatgcatcaggatcgctagctggtgtcactcatgactgttgctacaaacgtgctggagaaacgtggatggagcaccaaatttgtgagctacagagtttagcaactcgggtgagcatgatcacgtgtgcaaagacaggactcctgcagaaagcaactggtgtgagtgggattaaggctgcgttccacctgttttgctagaaacaagacgacctacaataagaagttccagtctatgccaataaacactggca

SEQ ID NO: 16630 - DNA, 613 bp, Homo sapiens
aattttaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgtctgggcagaccttatccaaagtctggtacaactgtccttagactgatgagcaaaggaggagtcaactaatgaagaaatgaataataaatttgacactgaaaaacatttattaataaagaatattgacatgagt

SEQ ID NO: 16631 - DNA, 290 bp, Homo sapiens
ataaaaacttaatatagtacaatgggttgtgaacaccattttgagttaataagcctagtgagacatttagtgttcatctttcatttacagagtattgtgactaagctatttttaagagaatcgagttattaagtttggagatcgcagaaacatctcatgcagtgtagagcgtttatgcagaaatgttgaacgatattgcagtattgagcaggtaaggaaagttaaacatctatgtgagagcaataatggagctatttgattgggcgtgatttgaacctgccagtgcaggg

SEQ ID NO: 16632 - DNA, 560 bp, Homo sapiens
ggtgtcagaaggctgggcagccatggcgtcctatattcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgccatgagctgcccactgatgacgacacttatgaggagcacagacgagataaggctcgaaaacagcagcagcaacaccgactggagaacctccatggagccatgtacacgtgaggaggttggggctgagtgctgccctctgcgtcttccttattaaccttgaatcctcattaaagggttctttaccct

SEQ ID NO: 16633 - DNA, 295 bp, Homo sapiens
gaaagacatttaaaatttttggattttaccacatgtagaaaggttgaactggtttttcagctataatgcatatacaactatagtgtgtaccgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatccaaaaaaa

SEQ ID NO: 16634 - DNA, 452 bp, Homo sapiens
atgaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgccaacatcagaaaacctgacggctatgattactatgccttttctaaagatcaatactataacattgatgtgcctagtagaacagcaagagcaattactattcgttctgggcagaccttatccaaagtctggtacaactgtccttagactgatgagcaaaggaggagtcaactaatgaagaaatgaataataaattttgacactgaaaaacattttattaataaagaatattg

SEQ ID NO: 16635 - DNA, 148 bp, Homo sapiens
gcagaacatcaccggcaggatgtaaccagcaccccatgttggattgagattcatcttcatgggcctcttcagtggctggataaagtccttactcagatgggctcccctctgaaccccatatcttctgtttcataatgcagaagtattc

SEQ ID NO: 16636 - DNA, 392 bp, Homo sapiens
ggaaaaaaacatatttaatattatgcccttggatctgtttctgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaatttgcagttttgtcttattaaagtggtatgtttttcagtgtattttttctgaagttgatctctttacatttcagctattactgtatgcaggaagaaactgacttgtaatctttgattttttttttttttttttt

SEQ ID NO: 16637 - DNA, 399 bp, Homo sapiens
gcctgcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttctggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtggctgtgggattaatttcaacgagaaggcgatccataaggagggctgtgtggagaaga

SEQ ID NO: 16638 - DNA, 228 bp, Homo sapiens
attcttgagtgtgcaagtccttttgccaagaattccaattattctgtaacattagagcacaatataattgtagacattctaagcatcggtccgtgtagtctaccaattgcacaaggaaggcatgttagccctccagattgaaaatgtatgtgacctcttgaactgaagttagattcccaaccattcaaaatgctggcagctgatcacatttacttctgataaaagtaa

SEQ ID NO: 16639 - DNA, 217 bp, Homo sapiens
gttcctttcaaacatgtgagttctttaacaaaaatgaaataaaccaggtgtctgtgatttctaattaaccaccgctggccattacacaggttttgttgtttggggtggggagggggcttttgttcccttttgacataatatagtcaatgcactaacaattatgtatattcaaacttgattattttaaattcgatcttcagctgtactgtaaataggg

SEQ ID NO: 16640 - DNA, 224 bp, Homo sapiens
  misc_feature 125, 126, 133, 134, 138, 141, 148, 149, 151, 154, 155, 157,163, 164, 165, 168, 173, 175, 181, 182, 184, 185, 192, 197,203, 205, 206, 213, 214, 215: n = A,T,C or G
gacagaaagtctacaggccagccaacaaaaatcagatcacttcacttctactcatcagcagagtcaccattaacctctattaattatagcacagaaaaaaaaaaaaaaaaaaaaaaaaaaaaccnnggggggnncccnggncccgggnncnttnnanccgggnnngcntttgncngggggnngnnttggggnccccnggggcnannccccccnnnggggggggg

SEQ ID NO: 16641 - DNA, 380 bp, Homo sapiens
gttcatgtgttaagtgttatagcaaaaaaaatacacatatggttaagttaatgaatagtttttgttttaccagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgtttggttgcatttcatttttggagacttaattaacgtgagattggcaattgaaatgcag

SEQ ID NO: 16642 - DNA, 441 bp, Homo sapiens
gacagccattgtgagactgatgcacaaactgtcacttggtttatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaaaaaaaaaaaaaaaa

SEQ ID NO: 16643 - DNA, 512 bp, Homo sapiens
gaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtaggggtataataatg

SEQ ID NO: 16644 - DNA, 255 bp, Homo sapiens
ctggaaccgaatggccaagagggaagaccccttgaagcaaagagcggacagagagtcctccgactcccccatgcagaacaggacgactcagggggttcaacatttgtcaacaggcccaaggactcacagttggaagactggagaagactttttaaaaagatctggatttttccttatgacttggaatccatctttgtcttgtataactaggtcatagcacaccattcatgtcagcagttaacagttttgaattcc

SEQ ID NO: 16645 - DNA, 185 bp, Homo sapiens
aaaaatcagccaggcatggtggcacacgcctgtattcccagctagttaggaggctaaggcatgagcatcgcttgaaactgggaggtggaggttgtagtgagccgagatcgtgccactgcattccagcctgggtgacagagtaagactctgtcccaaaaaaaaaaaaaaaaaaaaaaaaaaaaaaa

SEQ ID NO: 16646 - DNA, 497 bp, Homo sapiens
agataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgtcatggaacgcgttgaaaatgtaattatatctgaggaattctgtatagatagaattctgtatagatagagagtgtgaaacggatgattctatgctgagttgtgctgtgtatgtgtgaagtgagtgagttgggtgtattg

SEQ ID NO: 16647 - DNA, 521 bp, Homo sapiens
aggggaatttgactgtctcagtaggtagaaagagagaaatctctctcctgagaatttctaactgtaagctagcccttacatggatttgcagctcaaattcatactatctgtctgctccaaaaaacatgaagccaagaatttatttaaagtaattccagcttgatagtgcttcaaggcacctagaaaagaaacacaaatgctgagaatacagcactcgcccaaggcctcaaagaattcctacagttcaagttctaaaaaactcgaatttatagtcaaaaatcacaaaacaaagaaaaaaagcactatgagagagacagcagaaacaaaagacagcagcatcagacacacaaaatccgcagatatcagaattataagacatagaatataataaccatatttaatattttaaatatatatttaaagaataataaaaggacaatttaaaatatgattaaagaactgataattatttaaaaattaaggagatttgaaaagtaattaaatagactcaaaataataac

SEQ ID NO: 16648 - DNA, 650 bp, Homo sapiens
ccggctggaaccatggagggtgtagaagagaagatgaaggaggttcctgctgtgccagaaacccttaagaaaaagcgaaggaatttcgcagagctgaagatcaagcgcctgagaaagaagttcgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgcttcgtcaaatcttcaatggaacctttgtgaagctcaacaaggcttcgattaacatgctgaggattgtagagccatatattgcatgggggtccccaatctgaatcagtaaatgaactaatctacaagcggggttatggcaaaatcaataagaagcgaattgctttgacagatacgccttgatgctcgactcttgggaaatacgggatcatctggatggaggatttgattcatgagaaccatactgtggaaacgcttcaagaggcaaataacttcctggggccctcaaaatggcttctccc

SEQ ID NO: 16649 - DNA, 616 bp, Homo sapiens
ataatgtaggcaatctgaaggttactgtccagtgtgggaagcaaaaggaaatcacggtataagttttgctttctgtaatagcagaaggggctacatcctactgtgggaatgcagaaaagggagtgataagctgccttcatagactgtgctttcattttttgcaaaagtaaatgtaatcaacatgaatttgtggaaagtgtagcatatattgccatgtgttatgactttgagcttattttaaaataaagatggatgcctgtttctgcctaacatgttagtcagtgttatcaaagacaagaggcagaccattcattcactcatttccaaaacactgaatgccattctgtgcctagcgctatacaagacatcggaaatcagtgtcaataagctttgctttccaatcaacagggacgattttaattatagatggtctcctattaagtatgaattttagcagggattaaaattaggttgataatatgagaaaaaaatgaagattgaggccgggtgcagtgctcatgcctgtaatcccaatccttgggaggctgaggtgggaggacttgacccaggaatttgagaccaggcctggacatcatagggagaccccatctctacc

SEQ ID NO: 16650 - DNA, 408 bp, Homo sapiens
ggtgtacaggctcaagtttacgtggtttgacttctatgctagtgccaaggaaaggagggcctgggatttttttttaattggcttgctcatgtgtgaggggaaaagagaagtgggagaaaaggggtctgaaagctgtcagcagccagataatggagtcagatgatcttacatattagaaaattccaaggaaaccactaaaaacctattagaactaatacatgagttagcaagattgcaagatacaagatcaatatgtgaaaaatcaattttctttctatacatttacaaagaactatccaaaaatgaaattaagagaataatttcattcacaatagtatataaatatattaaatatataggaataaatttaatataatgtgtaaaacttacatggtgaaaactcaaaac

SEQ ID NO: 16651 - DNA, 196 bp, Homo sapiens
cgacgacccattcgaacgtctgccctatcaactttcgattttagtcgccgtgcctaccatggtgaccacgggtgacggtgaatcagggttcgattccggagagggagcctgagaaacggctaccacatccaaggaaggcagcaggcgcgcaaattacccactcccgacccggggaggtagtgacgaaaaaaaaaaa

SEQ ID NO: 16652 - DNA, 525 bp, Homo sapiens
aactgcattggatgtgagacaacgtaccgatggcattgtctatatattaacattgacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgcacagctaaaaagaaagaaatcgtttctaacagtaaatta

SEQ ID NO: 16653 - DNA, 554 bp, Homo sapiens
ctgatacttttattttattttcagcaaggttacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgcccgattatgagagtttctgtgcagaagtgcataatcccacatcaccaccatcttcaaagaaagcacctccaccttcaggagcatctaaaaccatcaaatcaacaaccatacgttcacccttaccaccaaacaagaagaagactaagaaagttatagaatcagaggaaataacagaagaacattctgttctgaaaatcaagagtcctcctcctcctcctcctcttcctcttcttcttcaacaattcgggaaaatcaagtcttccaaaaattcaggctgctaatagagaattacagaagaaacccaaaaaaaaaaaaaaaaaaaaaaaaaaaaa

SEQ ID NO: 16654 - DNA, 243 bp, Homo sapiens
gaatgccttccactgaaccgaggcactgttatagaagaatggtaagaagatacagattatagaatcaggtttagttctttgtgtttctttaatgatcacgtcggatttcatggcactataaaaagctcaccaagtgactttattgttattgaaattgatgaacagggacagttagttaataagaccatcgatgagcctattttcaagattagtgaaatacaacttgagccaaataattttccc

SEQ ID NO: 16655 - DNA, 408 bp, Homo sapiens
aaaaaagctagatcaagagaccttgagagcagagaacatatcccagttgttgctgatatatggcttctgcttctcttgtgtgtgcctcagctctgaagaagttcctgagaatgggttacagatgtcatgttagctgggattcttcccacatgtggctcttcaaaaggcagcaccactgtgcgcctgcacttatttgaaaatggaactttgggagaagtatccctgctagtggctcttgtaacttagcaaatgacaagtagggcttgtgtcattgttgccatcatatggaagataatgtttgcatcctttgaaacatttttatttgacaattcctcaggatttggaaggcttccaaggtggtagcttttagtgtaatgtgctggggtgggaaataaaagggttcctgcg

SEQ ID NO: 16656 - DNA, 186 bp, Homo sapiens
atggatgctgaaatctttggagttcagaaatacttttttttcagaaaagtttattggtatcacagagcacatatcaaaagaaagcatgcattttaaccacataaggatcgtctgagtaacaaaaacgggaagaaataacaaagaaaaagaaaattagaatcaaaagaaaactggaaaaaaaaaaaa

SEQ ID NO: 16657 - DNA, 640 bp, Homo sapiens
gggaaatctctctgctttcctctccattttgctgtgttcctaaacttactctgaaaaatgtctttgaaaatttactcatgcgcttgcattgcatttcttttggatattactggtctaagtagtccagttaaaagacaaagattgtcagacttgattaaaaagcaaggcctaactacactgtcaatacgagggtcaggtagaaatatcaagatgcaggttgaaagtaaaaagatggaaaatgatattccgtgcaaacagtaagcacaagaaagttgatatgattatattactagacagaaaaatttaagacaaatattaccagatataaaaaagcatatttcacaatgttgaagggtcagtttatcagaaaacatttcttaatttgtatgccaataatacaaatcaaagtatattaagaaaaacatcacagaactaagtagagaaacaaaaatccacaatcatagcctggtttttaaaacataatttatgggaattgatagggatagtccagtcctagcccccaaataaaaaggatacataatttgaaaagggctatcatgtgggcttaacctcacatttataaaactatacccgggaccggaaaataacttcaggggccatagacatcacatgatagacc

SEQ ID NO: 16658 - DNA, 443 bp, Homo sapiens
tgattttgatgaggggttggggagtggggagggtttcgaaccaagacttggagttaagaggatttttcatcttttgcatccaacaggcagaatatgatctgtgtccaaaagtgaacttgagtcaggaatggatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgggccttttcattcttggtacttgtgatgcaattaagtgaagat

SEQ ID NO: 16659 - DNA, 388 bp, Homo sapiens
gaggacaaaaattactgagtggcccttaaagagggaagtttgttttcagctgctctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcaggttctttttcttttaaatatcaatataaaggtaaaaaaaaaaaaaa

SEQ ID NO: 16660 - DNA, 154 bp, Homo sapiens
taaatggaggttctagccagggcactcactaagtttcaggctttcattgtttttccttaaattggtatggaaattttaaactcaagagccttcctactactggagtgtttggtcagcagtagatacaaaaaaaaaaaaaaaaaaaaaaaaaaaa

SEQ ID NO: 16661 - DNA, 616 bp, Homo sapiens
aaattgatgagccaattctaaatttgtgcaaaagtacatttacctagagtagtcaagaagacaatgaagaattagatgaaagttggaagacttacactaccaaatttgaagactgaacataaagctacctcatgaagatagtggggaacagagagttcagaaagtaaaccgacacatactcggttatttgattttcaataatggtgccaactattcaatgcaatggagttctccacaataaatggtgctggggcaactgctcctctatatcaaaaaaattaattttaaatggattattacagctagatgtggtggtgcacgctgtagtcacagctactcaggaggctaaggcaggaggatcacttaaggccaggagttcaagtcaagcccgagcaacatagtgagatcctcctctaagtaaataaataaagaaataaataagttattagacctaactgtgaaagctaaaaccaaaactttcttaaaaagaatataagagatatcttcatgaacatgggatatatgagaaaccaggacacagacagcactaatcataaaagggtaaacaatatcaacttaagacctgtgggcatcaaaagacatcattaagaaggtt

SEQ ID NO: 16662 - DNA, 600 bp, Homo sapiens
tatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaagccataaaaaatgctaattaagtttagaacaggagttgaaatgactctcagttttatctatagctccaattaggacaaaattactttacaaaaagcattaaaaataaaagaactgtatggtacttcaggaatttgaccagtccttacacttatctggcaatatttggcaggaatatcttcatacagagctagagaaccatggtggctgctatttacatggtaattggtcccagtgagctttatcaacatcaaccctgttataaaataaggtaatttggccctcctggaccggggccctttggtttagcttatc

SEQ ID NO: 16663 - DNA, 147 bp, Homo sapiens
aggaaaagacatcattacatcaaaaaaatacattcatatgtttatggcagcactattcacgatagcaaagatatggaataaagctaaatgtactttgacagataataaagaaaatgtagaatactattcagccgtaaaaaaaaaaaa

SEQ ID NO: 16664 - DNA, 538 bp, Homo sapiens
aaacgcctgacctcaggtgatccacccacctcggcccctcaaagtgctaggattacaggtgtgagccaccatgcccggcccagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcactcctatatttaattctcacaatcgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatggggttaagagaactggcgtatttggaatgctcttacactaacactgtctcattgtaaaatataaaaccccttactctaactacatttttattcctctgggagtggggtatccaggcaacatatcacttctgctatgtaat

SEQ ID NO: 16665 - DNA, 577 bp, Homo sapiens
ctgaagctgacagcattcgagccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgaagtatgcctgcgtgtgaccatgtgactttgcacagccaagatagtaagtgggatcgagacatgtaacagcatcatggaggttgaagatgccccatttggattggatgaattccaaatcctgctgcttgcttttaaatatggatatgctaatcacttacactttatgcaccaaaaaggaagggtataataatggtaacatggacatgaacttctttaaaaatctaccttgagggccggcccccatgtttgaaggatctaaca

SEQ ID NO: 16666 - DNA, 232 bp, Homo sapiens
aagtgagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgtgagtaccttttt

SEQ ID NO: 16667 - DNA, 419 bp, Homo sapiens
tcctttagtcaggaaggacgttggtgttttaggttggcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactatgatgtcatgaaagattttgaggagatgaggaaggctggtatctttcagagtgtaaagaatcttggaatataaagaatttcttcaggttgaattacctagaagtttgcacttgcttgtgttcctgaactatgacacatgaatatgtgggctaagaaatagttcctcttgataaataaacaattaacaaa

SEQ ID NO: 16668 - DNA, 364 bp, Homo sapiens
gaggaataaaagagggtaggaagcccaatgagtcaaaagaatgagatgatatccaatgaaagggaatgtagacttatgaaccaatagactttttttctatttctatcaatggaacttttttctagagaaatgaaaattaaagctttgccttaatcaactctgatcaagccaaacttaaaacattcagttctgcaacttgaagagagagattaataaagcaaaacatgtttagaaaatgacgagtaggatgttaaagagactttatggctaacagccagaggaacacagcctgattagctgggagaacagaaaatgcagggaagggcataactgtcctcagatatttaaagggctgtcatatgga

SEQ ID NO: 16669 - DNA, 587 bp, Homo sapiens
  misc_feature 558: n = A,T,C or G
tcgaggactgtgtggtgctattcattcctccattgctaatcagatgaaaggcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagccaccactagtgagcagaagtgccaggatgacagccatggacaatgccacaagaatgctctgagatgattgacaaattgacattgacatcaaccgaccccgccagctgcatcacaaaagagtngattgaaatatcttggggcggagctctgg

SEQ ID NO: 16670 - DNA, 235 bp, Homo sapiens
acagaggatgccgaaccactccagtcatgactgtccaaagtatgataatcacatgagagcgctcgtcgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatccc

SEQ ID NO: 16671 - DNA, 590 bp, Homo sapiens
gtccatctttcaagcactttaatttttttagctgccaatgtgtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatccggttgagcccaggaggttgtggctgcagtgagctgtgatgtgcccttatgctatagcctgggcaagagcgtgagaccctgtctcaaagaagaaaaaaagagaaaaaatacctcttttgaacaaacagacaaattagctagtaggatggagatggataccctctattacacacataaaaccggacaaaattcattggggggggaattataattaagttt

SEQ ID NO: 16672 - DNA, 655 bp, Homo sapiens
  misc_feature 644: n = A,T,C or G
gaaaaagaaggtgaaggttctcgcaactgttacaaaacctgttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaaggtgagatcttcgacacagaaaaagagaaatatgagattacggagcagcgcaagattgatcagaaagctgtggactcacaaattttaccaaaaatcaaagctattcctcaactccagggtacctgcgatctgtgttgctctgacgaaatggaatttatcctcacaaattggggtctaaatggcttaagaacctaattaaanagctgcctccc

SEQ ID NO: 16673 - DNA, 418 bp, Homo sapiens
gaatggctcttagagggtgggcttttgttgatgagggattggaaactttttttttttctatagactttttggagataacatcttctgagtcataaccagcctggcagtatgatggcctaatgcagagaaaacagctccttggtgaatggataagtaaaggcagaaaagattatatgtcatacctccattggggaataagcataaccctgagattcttactactgatgagaacattatctgcatttgccaaaaatttttaggcaattgaaagctaccaatttaaagttacggaatctaccattttaaagttaatgtgcttgcaagctttaaccacaaaaataatgaattgatgagaaatcaatgaagagggcaatggccatctcaaaatctgcttttacaaaagcagattaaaggcgaa

SEQ ID NO: 16674 - DNA, 300 bp, Homo sapiens
gcacagctacttcacaccttaaacttgctttgatttggtgatgtaaacttttaaacattgcagatcagagtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtcaaaatgc

SEQ ID NO: 16675 - DNA, 570 bp, Homo sapiens
aatgttttccttctccacatctcatgtgattctcttattacaggacacagcattgttggttctgccatgtactattttacctatgacccgtggattggcatgttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgccagtgaagagggtggagactgttcaagatcgacaagggagtacttgctaaaaatggcaacagaggaagtgagggagtgctgctgtagatgacaacctccattctattttagaataaattcccaacttctcttgctttctatgctggttggagggaaaaaatagaaatgacacccattccaaaggctttattacc

SEQ ID NO: 16676 - DNA, 404 bp, Homo sapiens
actgggtagaatctagtttttaattattattaatataaaggatcaaattaatttaaatatgattctgaagtctacagaacttttagttctgtgctgtctatgtggacactttggtaaaacgcaaattatgatatggacgttatcattggtctggtgagatgtttcatatttgtgacagttaatttaaaaattatgacttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgttccc

SEQ ID NO: 16677 - DNA, 430 bp, Homo sapiens
ctttgtacctacatagctttaaggttgatggtggggagttttgatttactaaaaataatctcgcttgccaaaaaatgcttattttaattttttttcccaactcctaatccagatctcttgcagctaattaaaaaaacttgtaaactctcagcggggcaatgactcatacttgtaatcccagcactttgaaaggtcaaagtgggaggatcgcttgaacccaggtttgagaccagcctgggcaacatagtgagacctgtctctacagaaaatacaaaaattagccaggcatgctgcatgcacctatagtcccagctacttgggatgctgaggcaggaggatagcttgagcccagaatgttcaggatgcagtgaaccaaggttgtgccagtgcactgcagcctggacaacagcatgagaccctgctccaaatc

SEQ ID NO: 16678 - DNA, 111 bp, Homo sapiens
tgcagtatgttaaagtaaatcagcttttgctaacatacttttgaaataatttaaaagcaccaactcttttttttttggccactgttatggtactgtatgtcagggtattgg

SEQ ID NO: 16679 - DNA, 363 bp, Homo sapiens
agcctttggattctgtttagatcaaattaacttgaaaatacatttttaaaataagacggggaatttgaatattgactggtgttacttaatatcgtggaaatatacttattttgaatgtgtatagtgactttgtgagtatgaaaggcaggggcctaattatttagtgatacatagtgatgtatatgggtgagggaaggaatggacgtgagtgtctgggaatttactttaaaataccttggaaaaaatgattgagagatagatgaagcagtactgctactatttcaagtacctggtaaatttagggtggcctatatatatgtgagagggtcattatactcctttctccacgtttggaaaaattgc

SEQ ID NO: 16680 - DNA, 303 bp, Homo sapiens
gaaggcatgaatattgtggaggccatggagcactttgggtccaggaatggcaagaccagcaagaagatcaccattgctgactgtggacaactcgaataagtttgacttgtgttttatcttaacctccagatcattccttctgtagctcaggagagcacccctccaccccatttgctcgcagtatcctagaatctttgtgctctcgctgcagttccctttgggttccatgctttccttgttccctcccatgcctagctggattgcagagttaagtttatgattatgaaataaaaactaaataac

SEQ ID NO: 16681 - DNA, 347 bp, Homo sapiens
gatcttatattgcaaaaagcttgtattccagtaaatgaatgtgtagatagcagatgttgctgcttcagaatcactcaccatgaggcctgggatatatacttttatacacaacactttttgtttctaatatacaagccaagatgtgaacaagtttcttaaacaatccagagaattacatctattttccacttcactttgtccaagtagacacacataaacaatggtgagcatgggataaggaggtaataattcagtcagcctttgcaatgacagtctatgacagtgacttgctgctttggaaaatgtgtcccttagtctggttaattaaaatggttaatataaagcaa

SEQ ID NO: 16682 - DNA, 209 bp, Homo sapiens
gttcgacggtaagagccagagggtccggcagagtgcggattcacggttgccccgacattcccacgctgtgtgcgggccatttttaaaattaagtttaaaaaaatcaaatgatttaaagtaaacagaaaaagtatttacattttgaaatttctattttaaagaattgggaagaaacactttttttttttttaaagaaaagcaaaaagatt

SEQ ID NO: 16683 - DNA, 501 bp, Homo sapiens
gacagtctcttattaaatgccctatccatcattaataggtttattatcagtgggcaaaacatgaaataatatgatcgaatggcaatcttgctagttgcgctacctaacagtaccatcttggatccttcaaaaccaaagacttgccccagcactggtgtggaaccacctggcttatgacccctatggatgatctttaggaaaagcagccctgtacttttaatacaggctttaatgaactatacctgtagagttccaaaggtcaaaatggaggcatttgctgtctaatattcaaacattagaaagggagctgcttttaaagaattccctgcaaatactgaaagcagtcatgcgaatgggaggggtgctcttggtgtagctggtcaaggaactttttttttcttttctcctgaactacatgattctaattggaatgttcattgcctctttttactcttttaaatgcttgagggagggttagggagggctatcgggctgttgcct

SEQ ID NO: 16684 - DNA, 436 bp, Homo sapiens
ggacttatggaaagggagaacctgcagggacattcatgcctctcttcgagggctccagaaggggcctcaaaactatccttacccaagtactttgtggacagtcttcagcgagtttgaagaccattagcctatgtgtaatttccttgaatacaggggaccctcttttgctgtttgacccttctctgtaacagcaaaaatatttatctagagtaagctgtcaatcaatgcctgttgcactgagaaatgatgtcagctttgtttggggttttgcagatcaatttcttgagaagtaacatacatacattgaaatgtatagtgtggccaggcacagtggctcatgcctataatcccagcactttgggaggctgaggcaggaggatcacttgagctcaggagtttggcaccagcctggcaacataccgagacctcgctctac

SEQ ID NO: 16685 - DNA, 495 bp, Homo sapiens
gtattacagctccacttggtgacttcctttctgtgtatcaggagcagagcagaggacaacttgtagaagacatgaccattaagagacatcaacttcgcaacaaatataagacaaggatacaaggattcctatgtgatgcagctaggtttttatacccttctaacaaatggtgagcaggagacttttttggaaataattagttgtgaaattccatttttctgacagccccttaaatttgaagttatttcatttgtagttaaggttatcacatccctgccaattttactagattttttcagagacaagcattcagcatggcattagtaatgatggtttaaactaggtgcagaactgtcccatgaagagaagaatgatatcagtatttaaataataaaagaagagacaatgtatggtttatagtgattcattttaagattgctgtattttgattttgtggtttaaaataaatgcattaaggatcttttaagttactgc

SEQ ID NO: 16686 - DNA, 513 bp, Homo sapiens
agaacggaggcaagcagatgaaatatttctactatgagttttctgttattaatcatgtagacacaagtagagtgatattgggttttaattgaaaatgaaaagtattatttcctgaggaatttattggatgcatggctggttctttattgtcttttgtgctcttttaacactagtggcgtgtcaaaaaattacagtaggatgcgttttgcccttcctctagagtaagaaatagaatgaggctatctttaattcctgaagagccaggaggaagggtttaaatagccataattaatgtacctatattgggaagcagggctttttcatatctctcttggacacatatataactgtaaatactaaaataaaattggaaatcagaattattttctatttattttagaggtaaggcatacctatttatgaagtgtgtttatgggttaaaggtgagcccaggatttttcctcccttttcttttacaaactaatctaaagtgctcaaaatccttggaagcct

SEQ ID NO: 16687 - DNA, 108 bp, Homo sapiens
gaccccatctctcaaaaaaatttaaaaattatctgggtatggtagtatgcacctgtagtcccagctacttgggaggctgaggtgggaggattgcttgagacgggcaag

SEQ ID NO: 16688 - DNA, 278 bp, Homo sapiens
ctcaatacataaagaacagcgtaactccagacatgatggattagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagc

SEQ ID NO: 16689 - DNA, 129 bp, Homo sapiens
ccatttgcaaatgatttaaatagcaaagaaagccatgaggtcttcaatactgttttaccccatcccttgtgcatatttccagggagaaggaaagcatatacacttttttctttcatttttccaaaagag

SEQ ID NO: 16690 - DNA, 379 bp, Homo sapiens
ggaccaatagtattatccaatgttcttcctctcacactcacaaagggagtcagaatggctgagtttgagtcatttgccccctgccaggaaccacggcaactgattaacagttctcaaaagactgcctgtactaggagagagtaggtcccaaaggcaactttaaagttctggaaccaagacggagggcgaatatgggggcaaataaaaacaatagatacctcctaaaactctttttcataagtgttatttaaagccatcaaactgtccaggtgcagcggcttatatctgtaatcccagcacttttggagtctgagatgggaggattgcttgaggccagaactttgagaccagcctgggcaacatagacccctgtccctgc

SEQ ID NO: 16691 - DNA, 150 bp, Homo sapiens
aggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaaaaaaaaaaaaaa

SEQ ID NO: 16692 - DNA, 489 bp, Homo sapiens
ttagaaggctttccaaatagcttatattggttgcaatgcttccagaaatatgtaagtacatggatacatttctctacattatgtcctatcaatttcttaatttaacaagcatgcaattattccctaaggtattttttacattttttttttttaattccatgagaggcttggcagggtcccaaatgacaatttactatttcggttcccttggggtataaacggatgggactcttctgaccattggaccatttatcccttggaatatggttatggccttatatattccatatttggaatagatttatatacatatatataagctggtaaacgtttatcagctatttcccctctattactgcccttttttacattcattggcaaaactattttatttttatatatccatacctatcaattgggctctgaggaatccttatttcacaatggcagaagttatctcctcccggcgggaaaaaaagccatcccaat

SEQ ID NO: 16693 - DNA, 403 bp, Homo sapiens
gaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacc

SEQ ID NO: 16694 - DNA, 520 bp, Homo sapiens
ccaaagaagactacaacaccaaaaggtaaaggcttaggggcaaagaaaaggaaagcatctggctctgagaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgtgtccttttgtcttctctgtctcagacttttgtacatctggcttattttaatgtgatgatgtaattgcggttttttattattgtggtaggcctttaacatttgttcttacacatacagttttatgctctttttactcattgaaatggcacgtactgtctgatggcttgtagaattgtatagactgccg

SEQ ID NO: 16695 - DNA, 518 bp, Homo sapiens
atcaactaattaaggcaattgtggtccctttttactcggattaccaaatatttgcttaaatattctaataattttgccaggataattttagccttaatgcagttgaaggttaaaacaaaaggaaaaatatttattctcctattttgtggtttctatgaaaaactagaagcagttgaatataaaatagcattttaattttttatatagtttaatatttataaagcaagaaacaacaaagtgcagatattatttgcttgatttattttgctcctgtttttccagcattaaaaagtaatgctttatatgatcttgttttattacaacaataaaccagaagcaaaagcttatcagttaaaatgtagtctgccattaagtaacctttccttttatcatttcagacttaaaattccattggttttggttatttttttcctatttggcattggtagaattgcaggtggacagaaagatgatatcaatcacatgtattttttatttgtgtcaagcctgtatttttt

SEQ ID NO: 16696 - DNA, 543 bp, Homo sapiens
aggcagccagcgcaggggcttctgctgagggggcaggcggattttgaggaaaccgcagataagttttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaaggcaatgcttttagattaaaatgaaggtgacttaaacagcttaaaggttaagtttaaaagttgtaggtgattaaaataatttgaaggcgatcttttaaaaagagattaaaccgaaggggattaaaagaccttgaaatccatgacgcagggagaattgcgcatttaaagcctagttaacgcatttactaaacgcagacgg

SEQ ID NO: 16697 - DNA, 564 bp, Homo sapiens
atattagcattggcaaaacttgagcctgtcctttgaaattaaccaaaaatgttgattctcatcacaatgaatgtaaaattttagaagtccaagagagagactggcctgagatttgtgtatgaagggataaatttgtataccacttgcacagatttcagtcttctgcctgagagtgcccctgtgtcctggccccagagctggtgttaccaaaacaggtccgggcattgatattattactaaggtgttatctgagctcatggtctcatgaccaagaaaattaaggagtgtggacacaaaagggtgaggttggagcaaaagtttaataagtgaaagaagaaagctctctgcagtggagagggaagtcagagtggttgccttttacagttgaatcccaagcttttatgagaaactgctctccaaccattcaaaagcttgcagacagcatgaaacactaagatcagacagaattgaagggagatagagacacaatacacccttcaagaaatccatgaatcccgggaggtgggttttttgaaaggaccacccaaaaaaaaaaaaaaaaaa

SEQ ID NO: 16698 - DNA, 571 bp, Homo sapiens
ggaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcaaaaaaaaaaaaaaaaaaaaaaaaaaaaa

SEQ ID NO: 16699 - DNA, 349 bp, Homo sapiens
tgctatttgaagtgtaattgagaaggaaaattttagcgtgctcactgacctgcctgtagccccagtgacagctaggatgtgcattctccagccatcaagagactgagtgaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgcacagtatctaagtaatttaaaggtgtgtgggcctttatatttgtg

SEQ ID NO: 16700 - DNA, 284 bp, Homo sapiens
atagccgaatacacaaacattattataataaacaccctcaccactacaatcttcctaggaacaacatatgacgcactctcccctgaactctacacaacatattttgtcaccaagaccctacttctgacctccctgttcttatgaattcgaacagcatacccccgattccgctacgaccaactcatacacctcctatgaaaaaaacttcctaccactcaccctagcattacttatatgatatgtctccatacccattacaatctccagcattccccctcaaacct

SEQ ID NO: 16701 - DNA, 272 bp, Homo sapiens
ttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggttatttttgttccacaagttaaataaatcataaaactt

SEQ ID NO: 16702 - DNA, 623 bp, Homo sapiens
taagaattatggcaggaaatacggaattatttctgagcttagtttatgacatccaaattaatacagcttttaaaggaatcgatggataagccatttgaaatttatatatatttgttttatgttgatgtcatagatctaccgtgtaaaatttaaacattatgaaaacagattttaaatatttagtaaagccttctctggaaaatgctaaacctttgttttaaaattatatctgtagatatctggtcactaatactgtgaaattatttcagcattgagtattgccggctacaagtgctttggaaactctttagctgttcatttttggcaaaatcttactttttgaaaagaccttattttagaggagatatcaatattgctttctcaagtttttcaaactaccattttgtaatttattagtaaattgtaagtgcccagaaaccactgtgcagtattcaaaggtccttgcattcaagggttaaaactgagtttatatacacacatactatactcttacaaagccagggaacaactattcaaactggcactgtgggactatgctagaggagttagcattgcttctttgcagacatggttgatttgaatacaacaccaaaaaattgggc

SEQ ID NO: 16703 - DNA, 235 bp, Homo sapiens
gaggcgggcggatcacctgaggtcgggagttcaagaccagcctgaccaacatggagaaacccccatctctactaaaaatacaaaattagccgagcgtggtgatgcatgcctgtaatctcggctactcaggaggctgaggcaggagaatcgcctgaacccgggaggcagaggatgcggcgagccgagattgctccattgcactccagcctgggcaacaagagagaaacgctgtccc

SEQ ID NO: 16704 - DNA, 374 bp, Homo sapiens
ccggggacgttgtctgcaggcactcagaatggtccagcttttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacccaaagttcttatgagattgtccaaaacaaagaaacatgtcagcagggcctatggtggcccatgtgtgctaaatgtgttcgtgacaggatcaagccgtgctttccttatcgaggagcagaaaatcgtgtgaaagtgttgaaggcacaagcacagagcagaaagcg

SEQ ID NO: 16705 - DNA, 330 bp, Homo sapiens
tggagagaccaatcctttgataggctctttactccaggagcggcaagatgttattgcaaggattgctcagcacttggagcacattgatccaacagcatcacatatccccggcagtcattcaacatgcatgactccagttcggttgcatctaaagtgtttaggagttcatatgaagacaaaaatttgttgaagaaaaataaggatgagcctcagtttccatttctcacacaaaatgtccttggtaggagacatcagtgatgggaaaaacttaatacctaataaatgtttacttctttaaaaataataggaaagaaaagggtctttgaacat

SEQ ID NO: 16706 - DNA, 430 bp, Homo sapiens
atatttaaacatgtttaaaaaatttatactcatgtgaaagagaacttctccgatgctagaaaaaagattatttttaaaaaatacagtattaatcagcagagaagcaccacccctggcagtctttataaaggcctgtagaataaggttccaactataggcttgtattgtaaggggagggcagcagaagaggccttgggtctatgcaaggtaagaagttggaattgagactaatacataaagctagggtcctcaaaactatacctgcagtgctatgaactgagtatttgtgtccacctcaaattcacagactggatctttaatccccagtgtgatagtgcttggagggtgggcctctgggaagtaattgagtcatgagggtgaaaccctcatgaatgggattagtgtgcccgtattacaaaaactagagagt

SEQ ID NO: 16707 - DNA, 660 bp, Homo sapiens
gtaatttatagattcaatgctacccccatcaagctacctttgactttcttcacagaatttgaaaaaactattttaaatttcatatggaatcaaaaagagcccgtatagccaagacaatcctaagcaaaaagaacaaaactggaggcatcacactacctgacttcaaactatactacaagtttacagtaaccaaaccaccatgctactggttccaaaacagagatatagagcaatggaacagaacagagcctcagaaataatgtcacacatctacaaccatctgatctttgacaaacctgacaaaaaacaagcaatgggggaaggattccctatttaataaatagtgctgtgaaaactggctagccatatgcagaaaactgaaactggccccttccttacaccttatacaaaaattaactcaagatggatcaaagatttaaatggaagacctaaaaccataaaaccctagaagaaaccaggacataggcatggcagagacttcaaggctaaaacccaaagcaatggcaccaaaagccaaaattgacaaatgggatctaattaaagagtctgccagcaaaagaaacttcatcagagtgacaggcacctcagaatgggagaaggttttgcatctatcctctgacaaagggctatatccgaatc

SEQ ID NO: 16708 - DNA, 210 bp, Homo sapiens
ggagaaagaggagactagccatgggccgcacaagagaaactgcatcagaacagcaaatgccacaaagcagccaggccgtgaggcgcaagcctgtagcccagctctgggggagctgaggagggaggacagatgtgcccagaggcaagggtgcaggagccgagacgcgccagtgccactccagcctggatgacaaagggagaacctttcccg

SEQ ID NO: 16709 - DNA, 266 bp, Homo sapiens
tctgttctgcaggatggattgacaaggacaagatttctggtgggttttgtagtcctaaatggaagatcagtccaggaggtactctagagttcttctggccttgacacatagaatgtagagagaggaatgcatcacctacgcctccctaagaatggtagtactttcagtaacaatagggaggtcaagattataagggaaattaatgacatctgttttcaggtatcagtacctcaagagattaaacatgataattaaagtgagagcca

SEQ ID NO: 16710 - DNA, 261 bp, Homo sapiens
tgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctttttttttaggaaccaaaaaaaaaaaaaaaaaaaaaaaaaaaaaa

SEQ ID NO: 16711 - DNA, 230 bp, Homo sapiens
ctggccaagaaacaaaagcaaaaccgtcccattccccagtggattcggatgaaaactggaaataaaatcaggtacaactccaaaaggagacattggagaagaaccaagctgggctataaggaatagcacatgatatggcacacatatttatgctgctgaaggtcacgatcatgttaccatatcaagctgaaaatgtcaccactatcttggagattttcgacatgtattcc

SEQ ID NO: 16712 - DNA, 300 bp, Homo sapiens
ttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtg

SEQ ID NO: 16713 - DNA, 607 bp, Homo sapiens
atggccgggctacaaaacactgctgaaagaaataatagatgacacaaacgaatgataatacattccataagaatctgtattctgaagacgaccatactgcccaaagaatcagtgaaattcctatcaaaatatcagcataatttttcacagaattagaaaaaaaaatcctaaaattcatatggaaccaaaaaagagcccaaatagcctaaatcctaagcaaaaggaataaatctagaggcatcacattaccccacttcaaactatactataaggctatagtaaaccaaaacagtgtggtactggcataaaagtaggtcttagaataatagaacagattagggaacccagaattaaagccttatcatccaactgatctttgcattgcatacaaaagcagagtggggaaaggacacactattcaataaatggtgttgaggaaattggataaccatgtagaagaatgaaactggcccttgcctgcccacatcaaaaattaactcaagatggattaaagacttaggatctgaaaccataacattctggaggaaaacctagcaaaaactcttctggacattggcctaggcaaagaatttatgactaagacccc

SEQ ID NO: 16714 - DNA, 530 bp, Homo sapiens
caaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgctcctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaat

SEQ ID NO: 16715 - DNA, 289 bp, Homo sapiens
cagacaccaggatgacacctaaaggtgcaaaagaaaaccatctctgcacactaccaaacagacagtgcgtgaacgaagcagaccctcctgaccacagccaaggactggagagcttggtgaaactggtgctcaaggtagaaattccctgcgattgctactgcaacttatactaaacgtcccaagtgaagtgaagggagaaaaaagagatattaagcaagaaggcccacttgtttatgcattgctttagaagataatctgtaattgcatattaataagtaaagttaacgtt

SEQ ID NO: 16716 - DNA, 441 bp, Homo sapiens
gattcaatgggtattgacttttgtgattctactcagactgccagtttccagttgtgtaccaaggatgatggcttcaatgttaatattcagccacctgttggagaactgcttttacctgtggccatgtcagagaaagattttaagaaagagcaaggagtgccaacaggaatgaatgaaacttctgctgtaatcattgctgcaccacagaatttcactccctctgtgatctttcagaaggttgtaaatgtagccaatgtaggtgcagtcccttctggccaggataatatacacaggtttgcagctaaaactgtgcacagtgggtcattgatgctagtcacagtggaactgaaggaaggctctacagcccagcttatcataaacactgagaaaactgtgattggctctgttctgctgcgggaactgaacctgtcctgctcaggg

SEQ ID NO: 16717 - DNA, 173 bp, Homo sapiens
tttgagctggggttttgagactccccttagagatagataaacagacccaagaaatgtgctcaattgcaatgggccacatacctagatctccagatgtcatttcccctctcttattttaagttatgttaagattactaaaacaataaaagctcctaaaaaatcaaaaaaaaaaa

SEQ ID NO: 16718 - DNA, 255 bp, Homo sapiens
tctttgaaaccaatgagaacaaatatgcaacataccagaatctctgggacacagctaaagcagcgtttagagggaaatttgtagcactaaatgctcacaggagaaaatgagaaagatctaaaattgacaccctaacattgcaattaaaagaaccagagaagcaagagcaaacaaattcaaaagctagcagaagacaagatataactaagattagagcagaactgaaggagatagagaaatgaaaaaccctcaaaa

SEQ ID NO: 16719 - DNA, 515 bp, Homo sapiens
gtgatggcaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgtctggaaaaaatgataaactagtggaaattaaagaaattaaggggtttatataatagacaggcccacctctcaaaatatttttaga

SEQ ID NO: 16720 - DNA, 540 bp, Homo sapiens
gcagtatcattaatgaaatcattaacctttgggctctggtccttcctttctaaaaacagcagattatagaaggtggctggcacagggattttcaaagggcaaaagtctcatcatcatctttccactcaaaatcctattattctacacttcactttgcaggggtcctagggacaggattgcagggacaggggacatgggaggaagacagaaaaattcaaaaccagcagatgccctacctggcaatgaattgaaaattaggggaaagcatctttggcgtgccttttattaagacaacagaaatttaagaacattttacatgcctctgtgttaaatggggaagcaagggaatgaaagtatttatttttagagctcatagttactcatcaagacatggctcccacccctcaggtttgacttgtttacagctcccttggggacttcttctgtgttcagggccgagcagaggccacctggttaaacctggcctttatagacctcacttcgcaacaaatttaaaaaagggtccagggttccattgga

SEQ ID NO: 16721 - DNA, 158 bp, Homo sapiens
agtattggagaaagaaattcgtacatctaggagctatagatactagtaccgcaagggaaagatgaaagactaattaaaagtaagaacaagcagagattaaaccttgtaccttttgcataatgaactaactagaaaacttctaaaaaaaaaaaaaaaaa

SEQ ID NO: 16722 - DNA, 540 bp, Homo sapiens
tgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgc

SEQ ID NO: 16723 - DNA, 522 bp, Homo sapiens
tatttggtcagattacctaaagtttaggtagaactctgaaaaaaaaatgatgaaggcgatgctggccaactttctttacagaattcataagacagtcagcgtcccaacttaaaataataaaaccactcagaacctcaatacttcattttttaagtgtaataaccaaactatcttgagattcactacttagttgtttcagtatagatactacttacaggtgtctatatatctaaaaatcataacatttcaagaattgaaggaatcccagccatccaagtgcctctgaatgtgaaagagaaaacagagtccaagaggttaaccattttggccaagaacattagctagtacatggcagatctgttcctcaaattgagatacttgatgtttttgctgggtaggaggagaaacaagagggacagtggccagttcacggagactatagcagtagggttctggggcaatgttgcggggagcagcatgatttatcacaacccttctgtacccagagagtccccagtgctg

SEQ ID NO: 16724 - DNA, 452 bp, Homo sapiens
caaaggatttcagcagaacttatacacagaatttcattttggcttcccgcgtctggttggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagttcaacttatgagacaatactgggctagctagtttactgatttggactctaaagacccaagcctaaaatagtagagctggctatcccacatgaaacttctctgatttca

SEQ ID NO: 16725 - DNA, 266 bp, Homo sapiens
acccccgaaaccagacgagccacctaagaacgggccaaaagagcacacccgtcgaggtagcaaaatagtgggaagatttataggtagaggcgacaaacctaccgagcctggtgatagctggatgtccaagatagaatcttagttcaactttaaatttgcccacagaaccctctaaatccccttgtaaatttaactgttacgtccaaagaggaacagctctttggacactaggaaaaaaccttgtagagagagaaaaaaaaaaaaaa

SEQ ID NO: 16726 - DNA, 317 bp, Homo sapiens
acctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16727 - DNA, 310 bp, Homo sapiens
acaaaaagaaataaaaataatagctgggtgtggtggcatgctcatgtagtcccaactactcaggaggatgagggggggggatctcttgaggctgggaggcggaggttgcagctgagctgagattgtgccactgcactccagcctgggtgacagcgagaccctgtctcaaaacatatatatatttaatatatatgtaaagccagagctgacaatgacactctggaacattgcataccttctgtacattctggggacatggatttctactgagttggataatatgcatttgtaataaactatgaactgtgcc

SEQ ID NO: 16728 - DNA, 486 bp, Homo sapiens
taaccttgaatgtaaatgacctacttaaaagagtggctaattggataaagaagcaagacccaactatatgctgttttcaagagactcatcttgcatgcagtgacatccataggctcaaagtgaagggatggagaaagacctgtcaagtaagcaaacagaaaacaaacaaaacagagcagggattgctatttttatttcagacaaaaccgactttaaaccaacaataataataaaaaaggacaaagaagggcattacatagtggatgataaaagattcaattcaactagaagatttaatgatcctaaatatatatgcacccaacactagagcacccagattcataaaacaaattcttagagacctgcaaagaaacttagatgaccacacaacaatagtgggagacttcaataccctgctgacagtgttagagcatcaatgcagaaaactaataaagatatttggggaccaaaacttgacacttgacc

SEQ ID NO: 16729 - DNA, 281 bp, Homo sapiens
cacttagccttggcgtggttgtagggtaataagcactctcgtgttgctgttagaactgtaattcattaagacttgtcagaattacaaatgcatagaatttctgatccaatgtactttcacatatgcaaaataaattacatataaaattatcagccaggtgtggtggctcacacctgtaatcctagcacttagggaggccaaggtggtaggactgcttaagcccaggagttcaggaccagcctgggcaaagtggcgagacctcgcctctacaaaaaaaaaaa

SEQ ID NO: 16730 - DNA, 289 bp, Homo sapiens
agacgatttagttggccaaagaagcatattttcttaagcaaatgttggccaagatgttactttatgttttcgggctgtcttcactgtagttggagaactgtgaactcttggtattaagtactcagtaggagcaaagaaccatttggaatgtctgtcaatcttaaatagaactgcagctgtttggctgagaggtgaaatggacctggatttttttttttggcgggggggctttgaaagtagtttttgtataacaaagaggtgatgagaactaaagtgattacaaaagtgt

SEQ ID NO: 16731 - DNA, 427 bp, Homo sapiens
acactacttgcttttctccattcatatttttatgagtagaatctgggcttttaaatttctcttcttattctttgaagcatgttgcatactaccctggtgggatggatggatctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagtactgaactatgtaaatatgtgaattttttattta

SEQ ID NO: 16732 - DNA, 549 bp, Homo sapiens
cctaactctggctgggaaagccttgctgttagaggctctttcccagaagttggacgaagaggctcaggcgttggtgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcaagtgagattcaagttgatggctgctacaagggggtaccgagctctcctgctaccgctgcatcatcccctttgctgtggttgtcttcatcgccggcatcgtgtcaccgcggtggcttacagcttcaattcccatgggtctattatctccatctttggcctggttgttctgtcatctggactttttttactagcctccagtgccttgtgctggaaaagtgagacaaaggggcaagaaagccaa

SEQ ID NO: 16733 - DNA, 204 bp, Homo sapiens
gcccgacattagtgttaggggctcggagacacagagcgcggccatagacaccgccgcaccggcactcatttatttatacctcccatcacacacgcgagcataggacacacacacactcacacctattagatccgtttccattgaagaatattacgctcggggacaagccaggtgcacgaccaaaaatttaaaaaaaaaaaaaaa

SEQ ID NO: 16734 - DNA, 315 bp, Homo sapiens
  misc_feature 124: n = A,T,C or G
gtttagaaacagaagacgttcttcccgggccgtgatggctcatgcctgtaatggcagcactttgggaggccgaggcgggaggatcaccaggtcaggtgttcgacaccagcctgaccaacatggngaaaccccgtctctactaaaaatacaaaaatgagccaggcatggtggtgcgtgcccgtaatcccagctactcaagagtttgaggcaggcgaataacttgaacctgggaggcagaggttgcagtgagcctagatcacaccactgcactccagcctgggcaacagagtgagactctatctccaaaaaaaaaaa

SEQ ID NO: 16735 - DNA, 225 bp, Homo sapiens
tgtggaggcaaaaggaggccctcatgaggacattgctgtcagctattgtggtaactacagagaatatgctatgctttggtggtagaccagatgaatattataggactagtagagttatatgaattgggggctttgatttgaaaatctgtttaaagggaactgattgctaaaacacatttcgttgtttttcttgccttaattgccaaaaaaaaaaaaaaaaaaaaa

SEQ ID NO: 16736 - DNA, 576 bp, Homo sapiens
gagacagcaagtgtcggatccgcaggcgcagccgtgcgatgttgtcctctacagccatgtattcggctgctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcacttctttccatactatgttacaacatcatcggtggacttgatgaagaaggaaaggggctgtatacagctttgatccagtagggtcttaccagagagactcctcaagctggaggctcagcaagtgccatgctacagcccctgcttgacaaccaggt

SEQ ID NO: 16737 - DNA, 607 bp, Homo sapiens
gcagttgtgagggcagttagcagcccgcctcttctgcttcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatgggcttgtttattatatatatttaatcctgcttgcactttacccaagggagatggccctttatcagttgaatgttagcagcgttatttcagagtgtggtgactgggtagagaaactcatgtcctcaccagccacagttcaaacaaaattttatgtgcaaaggacagcaccttcttgtatgttaaccccagtacgcttgtacatctgtgatacccctgtttattttcaaatgaccaaataaagcttttattttgtgctctgaaaaaaa

SEQ ID NO: 16738 - DNA, 129 bp, Homo sapiens
acaacacaaaggagctcttggaaattaaaaatataacaaattaaaaacaacaataaaatcatgggagacaaaattgaagaaatttgccagaaaataaaccgaaaaaaaaaaaaaaaaaaaaaaaaaaaa

SEQ ID NO: 16739 - DNA, 443 bp, Homo sapiens
tgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatcc

SEQ ID NO: 16740 - DNA, 186 bp, Homo sapiens
gcttgccgcacctttctttatagtaagacaccagctacttaaaaaataaggatatttaattcatcctttaacagaatgaagaaagtttaagaggtgatctgaaaattggattaaactcttgaactcttatactagaaaaaattgtaaataaactaatggaaaaaaaaaaaaaaaaaaaaaaaaaaa

SEQ ID NO: 16741 - DNA, 576 bp, Homo sapiens
gactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctgcacctgattttgtatccccctgtagcagcattactgaaatacataggcttatatacaatgcttctttcctgtatattctcttgtctggctgcacccctttttcccgccccagattgataagtaatgaaagtgcactgcagggagggtcaaagggagagtcaacatatggtgattggtccataataaacttctggtggggat

SEQ ID NO: 16742 - DNA, 640 bp, Homo sapiens
gaagctgacagcattcgggcccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaagactggctttctatctcttggactacactgaattcacccccactgaaaaagatgagtatgcctgccgtgtgaaccatgtgactttgcacagcccaagatagttaagtgggatcgagacatgtaagcagcatcatggaggttgaagatgccgcatttggattggatgaatccaaattctgcttgcttgctttttaatattgatatgcctatacacttacacttatgcacaaaatggaagggtataataaaggtaacatggacatgacctcttataatccacttgagggctgctccatgttgaggatctgacaggtgctcccaggagcctaggaggctggcacctagagggggggggagagaatcctttatccacatcacaac

SEQ ID NO: 16743 - DNA, 246 bp, Homo sapiens
aattgcctgagatcaggagttcgggaccagcttgggcaacatggtgaaaccctgtctctactaaaaatacaaaaaaaattagcagggcatggtggcgcgtgcctgtagtcccagctattggggaggctgagacagaatcacttgaacctaggaggggaggttgcagtgaaccgagattgtgccactgcactccagcctgggcgacagagcaagactctccgaaaaaaaaaaaaaaaaaaaaaaaaa

SEQ ID NO: 16744 - DNA, 138 bp, Homo sapiens
cactgtttacagctttcctccatgttatttatgaattttatattccgtgaatgtatattgtcttgtaatgttgcataatgttcactttttatagtgtgtcctttattctaaacagtaaagtggttttatttctatcac

SEQ ID NO: 16745 - DNA, 690 bp, Homo sapiens
tgctcataaggaaaggttaaaaaaagtaaaaggaactcgttaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttagggacctgtatgaatggctccacgagggttcagctgtctcttacttttaaccagtgaaattgacctgcccgtgaagaggcggcatgacacagcaagacgagaagaccttatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacgggaacaagttaccctagggataacagcgcaatcctattctagagtccatatcaacaatagggttacgacctcgatgttggatcaggacattcccgatggtgcagcccgttattaaaggtcgttggtcaacgattaaagtcctacgtgatctgagtcaaaaccggagtaatccaggcggttctatctacttaaattcctccctgtccaaaggacaaga

SEQ ID NO: 16746 - DNA, 342 bp, Homo sapiens
ttttcaaataagtaaaattttaaaaatgcgaaaggacatacagtgaaaattctctctcccacctctgtccacagcaaccaaattccttttttcagaggtagcagattaacactgtttatatgcatttaatttttagagtagtattgtatgccttgctgcaattaactgttagcttacattaaaacatacagtatgaaaattgtacaattaatatgtgcatcatttaaactattaataactgatctaattctagatcagtgctgtccaaaagaattacgatagaagccacatgtagtttttctatttagcagcattagaaaaatgtttaagaaaaggtaaaat

SEQ ID NO: 16747 - DNA, 382 bp, Homo sapiens
caagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactggt

SEQ ID NO: 16748 - DNA, 580 bp, Homo sapiens
gggatcattgaatgtgaaatgtgcagcacagaccttggaaaaaaggggtaaagctaaacccaaagtgaacgtgaagccatctgtggttaaagttgtgtcatcccccaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgttttggaatcaccttacagattccaggcccttttggatatattctttattcttttgctttttaaaaaataattttgtttcatatttaaagcacttgtattagtcaatgttcgtgtccgcattatttggaccttttgcccttacagaaagagaaatacttggtttgtgttttaaataaactg

SEQ ID NO: 16749 - DNA, 390 bp, Homo sapiens
tgattaaaataatttgaaggcgatcttttaaaaagagattttaccgaaggtgattaaaagaccttgaaatccgtgacgcagggagaattgccgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtcaaacttagaagaaaattggaaaa

SEQ ID NO: 16750 - DNA, 268 bp, Homo sapiens
tccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccaaaaaaaaaaaaaaaaaaaaaaaa

SEQ ID NO: 16751 - DNA, 571 bp, Homo sapiens
aatcatgtgataatccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcagctttaccctctgaacttctgatcgaag

SEQ ID NO: 16752 - DNA, 500 bp, Homo sapiens
gaaaacagaagcgtttgctaaatcagttgaggtacatggagagaccgagactataatagccaccaatactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgacctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaacttggtttacct

SEQ ID NO: 16753 - DNA, 444 bp, Homo sapiens
tcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttg

SEQ ID NO: 16754 - DNA, 640 bp, Homo sapiens
taagcttaattaatttaaatctgtagtataaggctctgaaggctgtaatagtgtgggtcccataagtctaggagtgatgtattacttaccttggtatttaattatgggaaaatgaaaaataatggaacatttattttctttaaaagttatctctctcaaaataaggctgttaaaataattttaaaagattaaaaaaaactatatgagtgcttttttacgtaccatgcactgttctagactctggggttatagttgtgaacaagaatgacactgaacttaagcttgtatcatagaattatgctattgcaagtgttgatagagcaatgtaaatattgaaagtaagcacaactggaattatacccgtcagtgaactcttgataggttagcagacgctatgttctaacacagacagtgagcaattttgatggtgaccctgggcttgatcttgggtttgcaaactttgaaatagggatcttattcatttggcttaagaatagcaaatgtaaaagatgggaaaatgagaaaccgcttttatgtttagaatgtgaaaaagatatgaatgcataaagctatccaaatggcctacacctatatattacccaactataagcttctccctgcccccaaagccttacaaaag

SEQ ID NO: 16755 - DNA, 330 bp, Homo sapiens
tcagcttgcagttttgttttaaaacttgttgaaccatgtttatcatcaaaaagaacttttggctacatttctatttccatatgtttcccatttaccttcctctctagatttatgtgccttcgtactaattagcacctgcactgaattcagaaagcagcacttgaatcaaaccaagtcaagctgctgtgaaaaaaaaaaaatccaagtcccaagatttctggttaatggagaggaacagcacacttggtggaggttcttatccacatgtgtcttcttaaagtatgagaatttagtatatgccttcagatatgcaaatatatccacatggga

SEQ ID NO: 16756 - DNA, 265 bp, Homo sapiens
tgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaaaaaaaaaaaaaaaaaaaaaaaa

SEQ ID NO: 16757 - DNA, 462 bp, Homo sapiens
attgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgaccttgaggccaatgagcataaacaaatataagaaagctgtcaatgagtttcttcaaaggagggaaaactttctgcgaatctaagatccatggagctagaattgtagaactaggctcatcagaatcgtgctattattgctccatcaaac

SEQ ID NO: 16758 - DNA, 443 bp, Homo sapiens
cgacccgctcctaaggcaggaagatggtggcgtgcaaagaagacgaaaaagtcgctggagtcgatcaactctaggctccaactcgttatgaaaagcgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaagctgcaaaattttccttcaataaaatttgcttg

SEQ ID NO: 16759 - DNA, 297 bp, Homo sapiens
cagaaaaagaacataaactgatcaaaaactcagcatctccagcctttcatttcctgctattcaggaaattgcttagaacatcttgatgtcctccttgttcttcctggacagtgactttttgggagtttgttcctgctgcgtaatgtgatacccacttcagattttttttttatcaatacatttagtaagttgaacttctgtcaagttttattacaaaattacttgttaaaacaatttttactaaactgcatttctatctagcatatttttgatatggaagtgatagtatagtatagt

SEQ ID NO: 16760 - DNA, 521 bp, Homo sapiens
gaaaatggagaaagacctagaaagaaaaaggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcgtctcagaaagagggaagtgatggagacaatgaggatgatgaagatgagggaagcgggagtgatgaagacgagaatgatgaaggcaatgatgaagatcatagtagccctgccagtgaagggggttgccagaagaagaaaatggagaaagacctagaaag

SEQ ID NO: 16761 - DNA, 471 bp, Homo sapiens
atacattgtttcccaccataaatggcacaatatctgaagatggttggtcaaactatccctttatgcaatcgtcttcatattgtttttatgattctaatcaagctgtatgtagagactgaatgtgaagtcaagcctgagcacaaaaagataatgcacgatgagattgcctaccatcttataggatatttactatgtatttatacgttaagacctctatgaatgaatgtatcagagaatgtctttgtaactgtttaattcaacctgtaataaaaatctaactaactaactcatttatttctattaaaaaggtattgcctttaggcggggaatgggaatccttgctgcctgttgcagtcattctgaaaggacctttccctgacttacctttcaacatgctcaatcttatcaacgctcattttgtatttttcaaacaagtataaaattctgcaataaagagatgtaggttttttt

SEQ ID NO: 16762 - DNA, 521 bp, Homo sapiens
gctttggaaatttccgatttgctttggtaggattaatctccaacgacttaatattcctttcccatctggaaactggatggaataatagcaagatggctgctctggtaggagcgcattttccttgtcttctgggaggagagattgagagtatgttaaaatgtttttcttctcagtgtatctcaccttgtaaatattatttgacttcttaggatgttaaaacaagccattaaaatttatatttctacctacctatcttataaaattacagattgtcttcaagcagagtgagttaaaggtatttcaagccaaaccccagtatatgatgcagaacaaggacccaaagtgaggctgaaaggtgaacttgcaagtacaggcttatcatttcacggaatatgattatttagctattttaaagcagttgcttatctactacaggttacttattgtatggcaaaaatgaaaacacagatctctgtggatccaaaaacattttggaagctatgttaagacatcatttacgt

SEQ ID NO: 16763 - DNA, 367 bp, Homo sapiens
atcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggcaaaaaaaa

SEQ ID NO: 16764 - DNA, 182 bp, Homo sapiens
tactatattccaaataggtttttacatcggaaaacgtaattcttgggattctttcatacattttcatcaaaacttccagggcgattatggatccatatctgcggttaaataggccggtataatagatttggtccaaaagtttctgggcctaagggggggacccggtacccagataaatcctg

SEQ ID NO: 16765 - DNA, 460 bp, Homo sapiens
gatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgcccacttcacccagaattttagaaactagaagtctgggaggtactatatcagctgtagttgggtaattccaagtgctgatagtactattcatctttttattattgtgtcagatgaaacaaatgccaagttgcaaaatatgcagatttttattatataatgggtttaggcataaattattaacaagccatgccttatgtgttcatcttatatttttc

SEQ ID NO: 16766 - DNA, 379 bp, Homo sapiens
caaatgttttgaaatgatatgaccagaattttaagtagttaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaa

SEQ ID NO: 16767 - DNA, 428 bp, Homo sapiens
ttggtagaggtcagttttaagaagtgttaagtgcttgctatttcccagggcattgtgttgggtgttaataatataagatgatagcattaaaagagctttgtaatttattgatggaaacatggatgtcagcaaagaaatgtgaagtgccatagcttactaaacctgctaaagtacttgacagtgaggcacacctgcagccccatctattggggaagctggagtgggaggctgggtaacatagtaagacccctcccatttctttaaggagaaattgcttaaacattctttttactactgcgggtgcaacattgtaaattttatagcagcagtgtttcacatctaaaaaccactgtattctttaagaaacattcaacagtaagcctgtataacaaggtggcttaacttgcttgtggatatcctgttaattt

SEQ ID NO: 16768 - DNA, 238 bp, Homo sapiens
gaggcagccagcgcaggggcttctgctgagggggcaggcggagcacgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaaaaaaaaaaaaaa

SEQ ID NO: 16769 - DNA, 531 bp, Homo sapiens
aagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaccttagatagagggcatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtatcatctaagcacttgatcaagaaatatacatgttgtacaagctctcaattttgttcatttattatcaaattttaaaatacaagtttggtatgtgatttggaaaagatgccttctggatcttaagccagt

SEQ ID NO: 16770 - DNA, 262 bp, Homo sapiens
taggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacatt

SEQ ID NO: 16771 - DNA, 382 bp, Homo sapiens
tagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgtttcatgtctcatcaaaagacaataccacattgcatcattttacaaaatatgtggcattttcatttcag

SEQ ID NO: 16772 - DNA, 126 bp, Homo sapiens
gggatcgattccggagagggagcctgagaaacggcttccacatccaaggaaggcagcaggcgcgcaaattacccactcccgacccggggaggtagtgacgaaaaaaaaaaaaaaaaaaaaaaaaaa

SEQ ID NO: 16773 - DNA, 523 bp, Homo sapiens
ttatggccgggagaactgttctgagttcactgtagcaaatgaaagttttacaactgtactaatgaacaaaaaccctaagctttgttgagggggctttttctgctaattgtcttgattgtaaaactgcctatcttaattttcttcaagcataattttaaacgacttaacatttctcttatacataaggatgtcctttacccaaaatgaggagatttggaactgaaactaatatccagggacacaacattgggtatcatcaaaggcccacctttaacatcaaggacaagttgatcactgagataagagctgatagttccatttttattcagctccacttctgcctgaattgcccatgttcagtccatagagctactttagctgcaggtgtgtccgccccaatcacatcatgacatgtatcactgcctatacgggctaagaaatgattaattggcagtagtatgtcgctaaagtaaggtgaattaaggtcccttttatcttaaggtaaccaggcataggccatgaa

SEQ ID NO: 16774 - DNA, 478 bp, Homo sapiens
aatgaaaaaaaattaccacattcccccctactgtctagacataactgctgtattttaaaaatatatgtaattatttttaaatactttcaaaattggaatcatataatatgttgttatacatatgtgtgtatgtgtgtattaattaataacctgcttttcacataacaatatgttgtgaattttatgtcattattttaataactgcctaatgcaaatgaaccacagtttgtttaatcacccattattggacataaagattctgtttttccctgtaacacataacactttaatgaatcttcccagtatgtcactattttcctagtatgcttttttaggaggggaatttttgggtcttaagcttttttgtaaatgttttaaattgccctcctgaaagaccaatatgaactcccaccggcagagtccccatttccctttttgatgactgaaaatagtaagggtgaatttttttaaaacatgt

SEQ ID NO: 16775 - DNA, 600 bp, Homo sapiens
gaattagtacccagcccaacttgaaaaccctagtgctagaccttgtatttttaaaagtttgtgtctttttagcaagttttacaagtctgatattcagttcagaaaaagaaccactactttatgcgcctataacttcagcctggcaggctttgaattctttagccaatggaccatgcagtggtggccaaatgtcaaaagcatgaaaagtaagaaaactatgtttggctttgaaatgctttttggtacttataattgaattggaatgtctcctttctgagcattcacagtatttcaaacaaattaagaaaaacacccaaaagaactaacctgaagaatctggaaatctgcctgcttgccccaaacatcttttttctggtcttccttttatgacaagattgaatagcattatttgtcaaacagacttgacagagctgtctgtttgcccataaagtgtctcaaacttgcctgtttaggtgtaggatgtaactaaatctggtctttaaaaggcctctcctggtattaagccaggtaagagaagtagaatctcgaatcacctaattggaaaggggacacaggttgcccttctcagccgtgggttcc

SEQ ID NO: 16776 - DNA, 496 bp, Homo sapiens
ttcctgtggggcataattaatgttagataaatagaattttgggaaagaaacttacgaggtcatttagttcagtccccttattttacatctgaggctgctgaggatcagagaggttaagtgagatgcacagagccaagttcagccaagttcattgaggaatgctgaatcctgtataagtgtatttccactattctaagcaattctgctatcctgagagaaaaggaggcaaattctaagataggaagaaaagaataaaagaactaaggtgaatgagaatagatgataatacatatatttgtcagcagattgcatgttgatttttggttcccatttaccagtactcacttctcctcacctctatctgctttaacatccctttcttgtcaatgttataagaatatgtggaatggcgtgaacccgggaggcggagcttgcagtgagccgagatcgcgccactgcactccagcctgggtgacagagcgagactccgtctcaa

SEQ ID NO: 16777 - DNA, 431 bp, Homo sapiens
atggccgggtacatacattcatacacaactggttgtctaaaactcagatttagaaagctcagaaaagtaccaagaaaaaagagaaggcacgtcaggagatatctctgagtcagtagaagggaagatagaagttcagggtgctaaaattgtatactcaatgaatataaaccaaatgattcatatattttaatatatccaatggtatcataaccaaattctaccttatgctccagccccctcacatgagccttcagaccataatcaaaacatattgatttcatagtttatacttaattccattgacactggaaatttaatttctcacaccatagcaaattggaagtagtgatcacaagtctatagttaccttaagtagtcacactgtcaacagaggattgaccttgggaggagatagaattattttatataaa

SEQ ID NO: 16778 - DNA, 498 bp, Homo sapiens
ggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgc

SEQ ID NO: 16779 - DNA, 510 bp, Homo sapiens
cattcagtgggggaaaagacggtttctttaataaaatgtttagggaaaactggatgtttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccacctgatataagggctcagacaaatctataggaaaacaatctaataatctgataaaaaaaccaaaaaaaaaaaa

SEQ ID NO: 16780 - DNA, 360 bp, Homo sapiens
ctcctgttgctaaatatgaagagtatggaacattcggatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcg

SEQ ID NO: 16781 - DNA, 506 bp, Homo sapiens
gcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgtatttatcaatttttcccagtattttatacggaaaaaattgtattgaaaacacttagtatgcagttgataagaggaattggtataattatggtgggtgatatttttatactgtatgtgccaaagcttactactgtggaagaca

SEQ ID NO: 16782 - DNA, 607 bp, Homo sapiens
ggccggggactatacttatataaatgtgttattggtatatgttccaaaattatgcaaaactcctataattctgatatgacttagtgtacattatcagtcataattatagttcttatgttacattattgtgtgctacagagttaaccaaatttctttgtcaattgcatctttaatcagctgtcctaagacttttgtcacccacagacaattgtcttgttttaatccttttcaaaaggtggttataatcagctataggactctgatgggtactctaaaatgcaagcctctgataactttgaaaattgtgccattgctggcatgatggctcacaactgtaatcccagcactttgggaggctgaggcaggcagatcacgtggggtcaggagtcaagactagcttgccagcatggtgaaatgccatctctactaaaaatcaaaaatcagtcaggcatggtggcatgcacctgtaatcccagtactcgggaggctgaggcaggagaatcacttgaaccctgggaggcagaaggttgcagtgagctgagatcgaccattgcattccagcctggcaacaagagggaaacctccgctcaaaaaaaaaaaaaaaaaa

SEQ ID NO: 16783 - DNA, 260 bp, Homo sapiens
aaacttttgtcctttgaggctaggcagctccctgccctccgtgtgtgtctgttatctgggggagaggagtgtggaagggttgggggaagagctccagcctgtctgctccccagctctgtagtggcagaccagcgtcacctttgaagtatacgtgagagaaatatatttacaaatgctttattctcttctttaataaaaaatgcaccagtattctaaaagcaaaaaaaaaaaaaaaaaaaaaaaaaaaaaaaaaaaaaaaa

SEQ ID NO: 16784 - DNA, 491 bp, Homo sapiens
gatgacttggtgtctaatgtgtattgctacacacctaacttatggggccaaaatagcatgtcctaatgcttgctgctgatttaaacacatcaaaggtactgtgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggacctaatggccaactgggatgaggggactattctgagatgactattcagggctaacttgggtaggaagaaaataattaggtatttctccaaatgttcactggactctgccctttattctctcatctgtacacaaagaaccccaggaaagcaaacagtttgggtgggaactctggaattcccaaccatcactggg

SEQ ID NO: 16785 - DNA, 359 bp, Homo sapiens
tgtcttttaacagctgcaaaataaatattctttcaatggaatgacaattattatttttgccatatatttattttaaaaatttatgtataatggtaacctgagcctgcatgttattcatgtgtggtgccatactgatctttaattttaatatgaagcaagtactaatatactaaagcataaattatataaaatttgctttatattttggattgcaaattaattgctgtactttatagaaaagtttcccaaatccgttttacttttttgtatttgaaatttaatcacaggtggaatcttaaagagagcatttagggatattgtaaacagatgttattaagggactaatgttaacaaacatt

SEQ ID NO: 16786 - DNA, 542 bp, Homo sapiens
agcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaattaaagatggagactttaagaacctgaagaaccttcacgcattgatcttgtcaacaataaaattagcaaagtagtcctggagcatttacacctttggtgaagttggaacgactttatctgtccaagaatcagctgaaggaat

SEQ ID NO: 16787 - DNA, 580 bp, Homo sapiens
tcagcgagcttggctgtgctcgagctactcgcgtgtttctggcctggaggcttccagcgtactccaaagattcaggtttactcacgtcatccagcagagaatggaaagcaaatttcctgaattgctatgtgtctgggtttcatccatccgacattgaagttgacttactgaagaatggagagagaattgaaaaagtggagcatcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttaatattgatatgcttatcacttacactttatgcacaaaatggaggggtataataatggtaacatggacatgacctcttataatctacttggagggctgctccatgttgagtatctgaacaggttgctccacaggtagctctaggaggctgcaacttaaagg

SEQ ID NO: 16788 - DNA, 445 bp, Homo sapiens
ttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcatttttgccagaattctttgcactactttaggtaaaaatagttaatctatttttctttgacgtcctagtttgcgtcagtgacagaacttactgct

SEQ ID NO: 16789 - DNA, 509 bp, Homo sapiens
ggcggccggaggctttggcagctcgggactttttgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtgaacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgcacggattagttgacaactagttagaagtttcagaataaacatgcatttcataactgtcaaatgtcttttaattctgagtccaaataaataatttggggatgttc

SEQ ID NO: 16790 - DNA, 319 bp, Homo sapiens
gcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgcttgtgttcctgaactatgacacatgaatatgtgggctaagaaatagttcctcttgataaataaaccaattaacaaatactttgaaaaaaaaaa

SEQ ID NO: 16791 - DNA, 494 bp, Homo sapiens
gtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgcaagcagtttctgtttctaaaggacaaaatacagagtgtgtgtcatttttaattagatctttcccctgctgagtggaaattccagtgcagcactgattgaccacagttgccaatctaaaagcacaaagacagagt

SEQ ID NO: 16792 - DNA, 315 bp, Homo sapiens
agccatgtagatgaagttagtgcggcaacgggatacagttccatattgccttaaacctccttgttttagacacactaacatttataccaaattgcagattattctgcagagagggaattgcatgtttgtgttgtgtatttagtatgaactcatttcagaatataatatgaactcagttatcacaagttggtggaaaacatttgcaggactatgaacatagaactgctgctggtatattttaactgcagattgtgaatctcactgccttatatgacttatttctgaccaaaagagggcttctcaataaaactactg

SEQ ID NO: 16793 - DNA, 483 bp, Homo sapiens
tgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagtcttttactgtaattggtgacaatgtcacataatgaatgctattgaaaaggttaacagatacagctcggagttgtgagcactctctgcaagacttaaatagttcagtataaattgcggtttttcttgtgctgactaactataagcatgatctgtaatgcatttttgatgggaagaaaag

SEQ ID NO: 16794 - DNA, 215 bp, Homo sapiens
aaggtgcaggattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagtcaaaaaaaaaaaaaaaaaaaaaaaaaaaaa

SEQ ID NO: 16795 - DNA, 593 bp, Homo sapiens
tattacccctggctacgatgattcagctcccacttctcagaaagcactgcacaaaggaggaggcagcagaaccccatttcagcttctcaggactctgcactaccccagagggaagaattaacaatgaatctgttcaaggaagcagcgaccttcaaggacgtggccgcggccctcacaggcggaggaactgcggctgctgggccctgccagaggaagctgtaccgagatgtgctggcggacaactttacgaacctgctgtcaccggggcgtgcacccttcaaacaagatgtatcacctatagaaagaaatgagcagctttggataatgacgacagcaacccgaagacagggaaatttagataccttacttgtaaaagctcttttgctctatgacctgctcaaacttaaacttggatttgaaggtagaagaaatgttggaagtcatttatatatgaagaaatgtgggaaggactcatatatgcatacattcctttgagtgactatgaatgactgccggcagtaacttctggctgtggttgaaactgggagcctacaaattgttttcttattgatccatatatggtaggaaagaca

SEQ ID NO: 16796 - DNA, 300 bp, Homo sapiens
gcactaaatgcccacaagagaaagcaggaaagatctaaaattgacaccctaacatcacaattaaaagaactagagaagcaacagcaaacacattcaaaagctagcagaaggcaagaaataactaagatcagagcagaattgaaggaaatagagacacaaaaaacccttcaaaaaattaatgaatccaggagctggttttttgaaaagatcaacaaaattgatagaccgctagcaagaataataaagaagaaaagagagaagaatcaaatagacacaaaaaaaaaaaaaaaaaaaaaaaaa

SEQ ID NO: 16797 - DNA, 218 bp, Homo sapiens
gagaagcctacgcttcgaagcgaaaagccctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaaaaaaaaaaaaaaaaaaaaa

SEQ ID NO: 16798 - DNA, 437 bp, Homo sapiens
ctgactccgggcttgttcgctggtggagtaggagcctagccggactggtcaggatgatcacggacgcgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgcactgaatagggccagtataaggggctcgctcttctactccctccccccaatataaaaatatagacttttttttgtggcccccc

SEQ ID NO: 16799 - DNA, 237 bp, Homo sapiens
gaaaccagcctggccaacatgctgaaaatacaaaattacaaaaaataccctgtctctactgaaaaaacaaagattggctgaatgtagtggcaggtgcctgtaatcccagctacacaagaggctgaggcaggagaatcgcttgagcccaggaggcagaggttgcagtgagctgagattgcgctactgcactccagcctggggacagagtgagactgtctcaaaaaaaaaaaaaaaaaa

SEQ ID NO: 16800 - DNA, 519 bp, Homo sapiens
cacttttaaatgccctttctgcagatggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagttagttgtaaacttaacccttttatacaaaataaatcaagtgtgtttattgaatggtgattgcctgctttatttcagaggaccagtgctttgatttttattatgctatgtataactgaacccaaataaatacaagtcaaatttatgtagactg

SEQ ID NO: 16801 - DNA, 604 bp, Homo sapiens
gaacagttgtgtgagtggaaattgcaatatcagctgttattagctctaactaggtcttgaaatttgcataatggcagctccagtgttacatgaaagttatgtggtgtttggaaggatgcctttttctttgttttttagcaaaggagtcttttaaatcatttgtatacaaaaggaattaggatccaaatgctgttattgatacaggtttgatgcttcaaatgtggcttttccctcccttaggggtatagaacaggctatgcttacaggcatcctctcattcgagagaagcctaggcacaagagtgatgtggaaatcccagcaactgtgactgctttttcctttgaagacgatcagtgccactctctcctctcaaatacatggcacagaggcaacagcgtgaaaaaacaagatggctgaactcaccaaatacttacatgaaagtgaatgtgcctgaggagtctcggaacggagaaaccagccccgaaccaaaatcacgtggatgaaagcagaagactcatctaaggtagtgggggacacctaccaaaattgaagatccaaatcaagttggtccttaaacacaaacccgaatgaggtcctaaaaaaa

SEQ ID NO: 16802 - DNA, 172 bp, Homo sapiens
cattatatgtgttcttaaatataaataaaggaataaaggtcatgttgaaaactcagaatttgtaagcactccatcttaattgtcggtgtttttgttgtttaacatataatgataaaagatagccttttttatgttagtaggtttctatgtttcgaatagtaagtataccttt

SEQ ID NO: 16803 - DNA, 270 bp, Homo sapiens
catactgggccaggaatacgacgaagccactgcagatgacaggaaagcaagagcccataaccttagatgggggtgcctggacatgtgcaggaaacgggatggaaaatcaaccaccataaagagaaaaacgagaggatgataaactggtgggggaatgcggcatgaaggcgcacctccacgagagttatgagagacctaagccaagggacgttgcccggcctgaagtcgcattgaccctcaacatccgggggaaaaatggtcaaaaagaaa

SEQ ID NO: 16804 - DNA, 513 bp, Homo sapiens
tttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacgattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccagtaaacctgcattgtagcaatttgtaaggatatcagatggagcactgtcactagacattctctgggggatttctgcttgtcttctgagcttttggaaggataat

SEQ ID NO: 16805 - DNA, 147 bp, Homo sapiens
gatgactgttacaggcttagctttgtgtgaaaaccagtcacctttctccggaggtaatgagtagtgctgttcatattactttagttctatagcatacttgcatctttaacatgctatcataggacatttagaatgattgcctttgat

SEQ ID NO: 16806 - DNA, 317 bp, Homo sapiens
aggatggaaaaccttgtttgcactaaccagaaagatccttgtctgattttggcagaattaaacggtgacttactaatgatagaactggtacaagtagcatcaactacaaagtgaaactcactttagcctacatggatctcactgtacatacatatcaatccctaaattgaatggtggaggttgcaaagtgtatttgcacattttaaatcattctgttttagtttttccacttttattcattcttatccctagccccttctcgttccctcatcccttctgtgggccaataaagtttattcttccccaaaaaaaaaaaa

SEQ ID NO: 16807 - DNA, 309 bp, Homo sapiens
aaacatgatcagcaagttgctcggatggaaaaactagcttttttggtagaagagccggaggctgacgagtggcggtttaagcccaccgagcagcggctgggaacccccccctctccaggttgaaacagcctgcatgggcaccgcgggagcgcagcaagtgccaagccagcgggggacttgctcacagcgtacacagccagccagagatccacagctacgtcactgaatcgttaatgcacatttggacttggtttctctggacctattcacaggcaacaaatacttatatgtgtgatctgtcagggaagg

SEQ ID NO: 16808 - DNA, 534 bp, Homo sapiens
tccggaggaaggaagaagaggacgccgggcgcgcagctcggtgctgattatcacaactgtttggtgacctacttcactgacctgtgaggattccttcccttcaagtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcaggctcaaggtggtaggctatgcttttgaccaggtagatgatcatttacagactccctaccatgaaacagtctactccttgttggatacactcagccccgcctaccgagaagcatttggaaacgcactgcttcaaagactggaagctt

SEQ ID NO: 16809 - DNA, 150 bp, Homo sapiens
aattacccacaagatccttattaatgacgagctgattattagcttgaggattcaaggtataatttacttcatctttgactacaagatgacttggctccaggattaatatccagaatattcaaggaactcaaacaactcagtaacaacatc

SEQ ID NO: 16810 - DNA, 439 bp, Homo sapiens
tgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaggaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaaaaaaaaaaaaaaaaaaaaaaaaa

SEQ ID NO: 16811 - DNA, 407 bp, Homo sapiens
agttgctggccactccaaaagactgttaaactcagaatacaagttctgaattactgtgtattaagtagggcaaacccaagaataccagttactgcaaaattcatttaggcacgtttaatagtccactccactctaagcattttttctaagtctctcacattaatgactaaagcctgtttacagtactaaaattctgtcattcaagcatcagtgattacatttcagagaaaggaaattcatttcagtaatagcattactgctatatcctaaaaaaaagagagaaaataaagaatcataattaacaaaactagtatccgtaataggatacacggggaaaaacattttaggagaaaaaaaaaaagtgtgttttacttgccacagcaggaattatataatgtaaacaccgt

SEQ ID NO: 16812 - DNA, 460 bp, Homo sapiens
cagctgaaaggctagacaataatggaaccacaaacataatcgatgatgtacagcaattacttttcaaagggaattcctgatcaatccatgaggataaatacatagacttcctcaggatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtgcacgcatctatcagagcccagctactcaggaggctgaggcagggagaatcgcttgacctgggaaggtggaggtttgcagtgaagctgagattgtgccctgcactccagcctgggtgacaggagtgagactccatctcaaaaataataataataatatta

SEQ ID NO: 16813 - DNA, 361 bp, Homo sapiens
ttattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgccagctaataaaatatgatttgtggatatgaaaaa

SEQ ID NO: 16814 - DNA, 370 bp, Homo sapiens
taacgttgaaaatggtatgtaagttttcttcaggtactgtttggaaggatgagaaagaggatatttaggataaaagaagaatagagaccttccgagtaaacagggaaaataaggactttgtgcaaaacatttccaaatgtggaattcgagaataatctcaaatctaagagtgtagttatttggatttttaaaattaggacttaggatttccacacctttgggaatttcacccttgatggaggattgcaagaataatctgatttttcagaacagaaggacagtctgctcaaaggtaaattccaggttctaccatggagaaatagaaattgctcccaactttccaaaaggtcttaagttctttcttcttttg

SEQ ID NO: 16815 - DNA, 495 bp, Homo sapiens
tttaatacactagagactatgaatgtgttatttgttggattaaactgaaccgaactagttactttccaggtggattaaagggagtttcttctgtagagggaagcagaaccatatctaaataaatgaagtatggttctctggagtagatgtgacttccatagaatggaggccggtagtaaaggaagttctccaggatatttaggggcaaaagaaaactacaacccaatatcccttatcaacatagttgcaaaaatgctcaacaaaatactagcaaaccaaattcgacagtatattgaaaagatcattcactctgatcaagtgggttgcattccagggatgcaaggatgttttaacatacacaatcaataaatgtgatacatcacgttaacagataggacaaaaatcatatgatcatttcaatagatgcgaaaaaagcatttgatgaaattcaacattccttcatgagaaaaccctcacaaattagggatagaagat

SEQ ID NO: 16816 - DNA, 424 bp, Homo sapiens
ctggtttgaagaatgttaagacttgacagtggtactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgt

SEQ ID NO: 16817 - DNA, 490 bp, Homo sapiens
cctaagcagcctgaggtgatctgagaaaatggttcgctatccacttgacccggagaaccccaggggatcatgcaaatcaagagggtccaatcttagtgccactataagaacactcgtgaaactgctcaggccatcaaggggatgcatatacgaaaagccacgaagaatctgaaagatgtcactttacagaaacagtgtgtaccattccgacgttacaatggtggagttggcaggtgtgcgcaggccaagcaatggggctggacacaaggtcggtggcccaaaaagagtgctgaatgtttgccgccatgcttaacaacgcagagaggaatgctgaacttaagggtgtagatgtagattctctggcattgagccatccaagtgaacaaagcacctaagatgcgccgcgggacctacagagctcatgggcggattaacccatacatgagctctccctgccacattgagatgatccctacggaaaaggaacaga

SEQ ID NO: 16818 - DNA, 435 bp, Homo sapiens
gaaagacgacaagttataaccacactgaatatagaagatttctaacccctatacctgctgcctaatgaattgggctagaaataactttgcaaggagagcccaagctaacacccccgaaaccagacgagctacctaagaacagctaaaagagcacacccggctatgtagcaaaatagtgggaagattcataggtagaggcgacaaacctaccgagcctggcgatagctggttgtccaagatagaatcttagttcaactttaaatttgcccacagaaccctctaaatccccttgtaaatttaactgttagccaaagaggaacagctctttggcactaggaaaaaaccttgtagagagagtaaaaaatttaacacccatagtaggcctaaaagcagccaccaattaagaaagcgttcaagctcaacacccactaccaa

SEQ ID NO: 16819 - DNA, 422 bp, Homo sapiens
gaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaac

SEQ ID NO: 16820 - DNA, 632 bp, Homo sapiens
tggccgggcataaactttagagtctggtgatgatggattgagcatacaaatataacttcatttccttctgcaattcactaacactataataaaataatttttttaaagagtcataaacctttaaggatgataagagtggtagaagagactatagaaacaaaattttggaagctgaaaagcaggtagatgagtggtaatgacttaggaggtctgagaaagtcagattccaaattagcagtggtgaaagctgaggacctgttcagtttacttggcagaatcttcagaagttttagaaattgctatctttaggaacctctggaagttgaggtatgggtagggctaaagacagaggattgattgaggctggtttagaagcagtagaaactctagagcaattcccctggtgagtgccattgggttactttatccctctcctcaaacaaatgttggatgtcttagacaacagaggtttctggatgggcaacatagcatagtttatggggacattcatattgaaataaggagattaagtaaattgtattacttctgctcccagaagctgcacctgggataggccggggattgaagaatagaagagcttggctgggaaccgcctcccccagagaagactt

SEQ ID NO: 16821 - DNA, 506 bp, Homo sapiens
aggcggagcttgcagtgagcagagatcgctgccactgcactccagcctgggcgacagagcgagactccatctcaaaataaataaataaataaataaataaataaataaataaataaataaccaaaaagtggaagcatcccaaatgttaatgaagtgacttatggaacaaacttaaacaaagtatggcatacctatacaatttaaacaaaatgtgttatgtccgtacaatagagtagtatttagtcataaaaaagaaggaagtgctgatacatgctacaatatggatataccctgaaaacattataagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgagttttccttttggcatgattaaatattcgggacttagtggtggtggtg

SEQ ID NO: 16822 - DNA, 260 bp, Homo sapiens
tggccggggaggcattgaggcagccagcgcaggggcttctgctgagggggcaggctggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaaaaaaaaaaaaaaaaaaaaaaaa

SEQ ID NO: 16823 - DNA, 199 bp, Homo sapiens
caagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaaaaaagaaaaaaaaaaaaaaaaaaaaaaaaaa

SEQ ID NO: 16824 - DNA, 250 bp, Homo sapiens
caaacctaccgagcctggtgatagctggttgtccaagatttaatcttagttcaactttaaatttgcccacagaaccctctaaatccccttgtaaatttaactgttagcccaaagaggaacagctctttggacactaggaaaaaaccttgtagagagagtaaaaaatttaacacccatagtaggcctaaaagcagccaccaattaagaaagcgttcaagctcaacacccactacccaaaaaaaaaaaaaaa

SEQ ID NO: 16825 - DNA, 140 bp, Homo sapiens
ctttcgaaccaccacatggagacgaagccggaagtggagaggccgaagtagaccagaaggtcacaggtcctgactcgcataccacccatcacaaggaagacagcacaggtcccaagatcacaacagcaaaaccaataaat

SEQ ID NO: 16826 - DNA, 475 bp, Homo sapiens
tttaagagccccaaacttatcatatttaaaggaagtttaattcgattactttttctgcctgaggtgggttaaattggatttagcttttgatctgtctgcatcttggctatcagcactgaagggcatccccagcttcatctttccttggtttctaagtaaataacaagcatgttttctagatctgaattgttcttgcaaatatgtaatggaaaggacacaaggagaaagaacaaaaaatagcattgctttgtgaaagggcatgtggtggtatcgggaaaccctacctaactgacccaaccaccagccttatggcgtcctggcctttttggcctcttctggactgctcatcatcctgcttcttgtcagtttcaggcgttttagagtaaattattttcctgtttgatttttctcctcactgctaaaggtttctgtaaaagcagacctgtctgtcatatcgagtaactagagaaaaggg

SEQ ID NO: 16827 - DNA, 255 bp, Homo sapiens
acgcaccaggtgcagcacaggaaggagaggcctactcacccacgtggtgtgggcctggcaaacagaccaaccccttcgatcatgccctcccggaaaaggattccaacgtgatattccttgaagtagatgtggatgactgcaggatgtcgcttcagagtgtgaagtcaaatgcatgccaacattccagttttttaagaagggacaaaaggtgggtgaattttctggagccaataaggaaaagcttgaagccaccat

SEQ ID NO: 16828 - DNA, 418 bp, Homo sapiens
tgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaa

SEQ ID NO: 16829 - DNA, 518 bp, Homo sapiens
cggttctgggacagctggagacagtggtttgtgactgaaataactttatcaaaggaaagctattgggcgaactatcttctccagcggagatggccaatgtgcttcgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgcacctcaatgggactgcttcacagaagaaaagcctggttcataaaactttgcctgatgttctagcagaacctttatcaagtgaaagacatgaagtttgtgatggcacaatatgtgaatgaatttcaggggaatgatgccctgttgacaagaaattaacaggcagaacctacttttgaaaggcca

SEQ ID NO: 16830 - DNA, 239 bp, Homo sapiens
cattgaggcagccagcgcaggggcttctgctgagggggcatgcggagcttgaggaaaccgcagataagtttttttctctttgaaagatagagattaatacaactacttaaaaatatagtcaataggttactaagatattgcttagcgttaagtttttaacgtaattttaatagcttaagattttaagagaaaatatgaagacttagaagagtagcatgaggaaggaaaaaaaaaaaaaa

SEQ ID NO: 16831 - DNA, 520 bp, Homo sapiens
gaaggatcatctatgtattcaagtaattattttttagataataactgtcttctggacttggtcttgaagtctgtacagattcagcctcagtagtggcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagatcttactgtaaccaaatttgagcaaggagtctcaaaggtaattctgaaccagaattacatgttaatgaacagtgtaccttttaacagtgtaa

SEQ ID NO: 16832 - DNA, 556 bp, Homo sapiens
tataactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaagaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttcca

SEQ ID NO: 16833 - DNA, 401 bp, Homo sapiens
aaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagttttttttttctgacacatggccaggctg

SEQ ID NO: 16834 - DNA, 424 bp, Homo sapiens
ctgcaaaaatgggtgaagaagagagccaatttttgctctcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggtgaaatgtttcgaatttaaaatgtttaaagcatgtttggttttattatttttacataattgtttaccactagtttttccactagctttttattatatatgtttaattatgtaattgttatcactagcttttattatataattcctttaaataatactactatcatcaacaaaa

SEQ ID NO: 16835 - DNA, 613 bp, Homo sapiens
tgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatccgcatttggattggatgaatccaaatctgctgcttgctttttaatattgatatgcttatacacttacctttatgcacaaaaagtagggtataataatggtagcatggacatgaacttctttaataatctacttggaggccggctccatgtttgatggatctgagcaggtgctcccaaggagctctaggagggctggcaacttag

SEQ ID NO: 16836 - DNA, 462 bp, Homo sapiens
accctcctgaaaactgctgcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaccaccataaagagaaaacgagaggatgataaactggtggtggaatgcgtcatgaaaggcgtcacttccacgagagtttatgagagagcatagcca

SEQ ID NO: 16837 - DNA, 355 bp, Homo sapiens
aaatgacttttttaaaagagttatgaagtacctactgtgaaactgccactgtaactgtacatttgtgactttatttaagccttataaaacctatgaaatgaacatagaataaagtagtttgcataaaattatatattgtgactctgcctctaatgaaatgggcagtcttatcctcagtcactgataggaacatagttctcaaagtcctttattaaactgatgagcatcaaacacctaattaattagtgagaatcaggatccaaacctctgagcttcagatccttaatccaatgcacttaactgattctacgtctctgggaaatctgtaaagagcaaccagcccaaaaaaaaaaaa

SEQ ID NO: 16838 - DNA, 522 bp, Homo sapiens
catcaaaaaactaatccaccatgatcaagtaggctttattcctgggatgcaatgttggtttaacatgaagatcaataaatgtgattcatcacataaacagaactaaagacaaaaacaacataattaccttaacagatgcagaaaaagcttttgataaaattcaacatgttaaaacttcatgttaaaaactctcaataaactaagtattgaaggaacatacctcaaaacaataatacccatctaggacaagcccacagccaacatcatactgaatgaccaaaaggtggaagcattccccttgaaaactggcacaagacaaagatgccctctctcaccactccaattcaacatagtattggaagtgctgccagggtaatcaggaaagagaaagaaataaagggcatccaaataggaaaagaggaagtcaaactattcctgtttgcagacagtgtgactgtatatctagaaaccctataatttcagcccaaaagatcctcagctgatgaacacgtcagcaaagtt

SEQ ID NO: 16839 - DNA, 460 bp, Homo sapiens
taaattaacatcacgaagccgaatcttttcgtactagaaatgctcaagaaccagctgggccaggaagtggagatcttgtccacgtccattgctcagctcaaagtggtacatgaccaagtatgtggaagccaaggactgactgaacgtgctgaacaagagcctcgaggggaaagaaatactaggcccactgacgagatctatgtatgcccctgcgaagccgcatgatgcggaacacgggctcacgagtgcgggaactgtggacgctgaagagaagacagccgacagtctccagggaccagaatcaagaggaggatggagtatctaaccacgcagaggtacaaaatccacccagcgcttcaggagaagcacgccatgaaacaggccgggatggaaatgatgaggcagaacacacagcagctcacaagccctgggggcagctcaggctactgctaaggcctga

SEQ ID NO: 16840 - DNA, 268 bp, Homo sapiens
gggggtggcaatcatttttcttcctatacatacaaaggatattgccaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaagcactgagttttgtaaatcaggaccctaaatgtt

SEQ ID NO: 16841 - DNA, 353 bp, Homo sapiens
ataagtttttttctctttgaaagatagagattaatacaactacttaaaaaatatagtcaataggttactaagatattgcttagcgttaagtttttaacgtaattttaatagctcaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagg

SEQ ID NO: 16842 - DNA, 218 bp, Homo sapiens
ggccattagccttcggttctggcatgggattaggaatggcttattccaactgtcagcatgatttccaggctccatatcttctacacggaaaatatgtcaaagagcaggagcagtgacttcacctgagaacatcccagcgggaggacaagagaaatcatgtttattcctcaggaatactgaagtgccctggagtaagctgccattcttctgtaacaatg

SEQ ID NO: 16843 - DNA, 251 bp, Homo sapiens
ctgcctagctctcagacctgtttaagtaacgttctttacattgaaacaagtcaaccgaagctttgtggtgcaggggctgagggtgccccatactcagtgggagccctggttgggccccaaactctcccagcagggtcctcggtttcctcatttgtgaaataaatgagtgggccacgacgttaataagcccaagagaactgtgaaggtggtagtcccttgccctaattggtgctcaataaagttgttggtat

SEQ ID NO: 16844 - DNA, 459 bp, Homo sapiens
gtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaataagtatttcagatacttgaagaatgttgatggtgctagaagaatttgagaagaaatactcctgtattgagttgtatcgtgtgggtattttttaaaaaatttgatttagcattcatattttccatcttattcccaattaaaag

SEQ ID NO: 16845 - DNA, 309 bp, Homo sapiens
caaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaacttaaaaaaaaaaaaaaa

SEQ ID NO: 16846 - DNA, 463 bp, Homo sapiens
ctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagataggtaagtgggatcgagacatgtaagcagcatcatggaggtttgaagatgccgcatttggattggatgaattccaaattctgcttgcttgcttttaaatatg

SEQ ID NO: 16847 - DNA, 279 bp, Homo sapiens
accctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtctaaaaaaaaaaaaaaa

SEQ ID NO: 16848 - DNA, 529 bp, Homo sapiens
ggccgggtgcctgtgctgggcatacaaccctctgctttcacatctctgagctatatcctcattagtgaaggtggcttttgcttgatagtttggctggggagtacttaattcttcccatttcaaaaggtaatgttgcctggggcttaacccacctgccctttgggcaaggttgggacaaagccatctgggcagtcaggggcaaggactgttggaggagagttagcccaagtataggctctgccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgcccctgccccagggctcttcagaaagcatctgcatgtgaacaccatcatgcctttataaaggatccttattacaggaaaagcatgagtggtggctaacctgaccaataaagttattttatgatacaa

SEQ ID NO: 16849 - DNA, 414 bp, Homo sapiens
atcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgtttaataaaagattacattccgcaaaaaaaa

SEQ ID NO: 16850 - DNA, 277 bp, Homo sapiens
agaagacattgaataaatttagtcacaggttaaatttcgtgatttttttttcttacagagatttactaatatttcagaagtattatactgttttcagttttcaagaggactgttataaggattgtttttacataatcatattgaaaaagctacctgtgggctgggcatggtggctcacacttgtaatctcagtgttttggaaagccgaggcaggagaatcgcttgaggacagaaatttgagacaagcctgggcaacaaagccagaccccatctctac

SEQ ID NO: 16851 - DNA, 448 bp, Homo sapiens
aaacactggactcttcatccaaggcttgacttaagagcaggacaaagcgaccccagcgcccatggaacatacgggcttaggtaggggacctgaaaaccacagggattatcacatcgggagcgccaaaccaccatagccggctatgtctccacacggtgcggaagggcggacctgtaccaccggggccaaccagggctcctgcaaaagccgcacaggcttcacagggcagaagtgtgagactgagggccaatgaagtgtgacattccaggacactgccagcatggtggcacctgcctcaacctgcctggttcctaccagtgccagtgccttcagggcttcacaggccagtactgtgacagcctgtatgtgccctgtgcccctcgccttgggcaatggagcacctggcgcagactggtgactcacttttgagtgcactgcctccagaaac

SEQ ID NO: 16852 - DNA, 442 bp, Homo sapiens
catcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagtagagtggctatggtgggcagacaaagccaattttccggaagaaggctaagaccacaaagaagattgtgctaaggctggaatgtgttgagcctaactgcagatccaagaggatgctgccattaagagatgcaagcattttgaactgggaggagataagaagagaaaggccaagtgatccagtctaaactttgggatatttttcttcaattttgaagagaaaatggtgaagccatagaaaagtacccgagggaaaataaatacagtgatattcttacac

SEQ ID NO: 16853 - DNA, 312 bp, Homo sapiens
gcctgtgaacatgggcacagtgaggttaaataattcacgtggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaat

SEQ ID NO: 16854 - DNA, 572 bp, Homo sapiens
ccacaaaaaacagttttcaataaccattatccaaggcctctcaccttttcctcaattaagaacaccggtccacatgcagctcatgtaaatatcagatgctttagacaggaagacaaactccatgatggcacttacttggtgccctagacagaaagggaagtgcaacacataccctgtggtcactatgatgatactacctctttagtaataaattgattaattttttttgtttcttctggaaaactaaattattgctgcatatgtttttccccagatttctggatttggggtgccctttaggaattcctgcctggcttaactctaacatgctgcttagtcccaggacataaatttcaattctgtgaatattacaatctgtagttacttcagcctgcgaaataattttaaaagagaagtctacacttggttttactattggcttcgtcatgggaataagggggatatggccttccaaggtgatggttatacagggcattatttgctgaataattaacccattatttggaagccattatggtgaagtcatcatctcattatgtcatcagacacct

SEQ ID NO: 16855 - DNA, 175 bp, Homo sapiens
tttttcatccctcatctcatttattccctaaaacagcccaataagataggttgagtatttgccattttacaacaaattaaaggacatagtagagattagcaatttgcttagaaacacacaactagtcaatgataaagatgggatctttatgtcactaaaaaaaaaaaaaaaaaaa

SEQ ID NO: 16856 - DNA, 657 bp, Homo sapiens
atgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcatgtcggcgtgcttttcctcatatcaagcataactatgagtgtttaagtgtatgtgcagctgccttcatggaagacttgcggcaatacatgttttcatccttgaaaaacagtaagaaatatgctcccaccgaggcacagttgaatgctgtgatgctttgattgactccatgagcttggcaaagaaagatgagaagaccgacacccttgaagacttgtttccaccaccaaaatcccaaatcctcgattcagagatatttcaaggtctgctgcccagagctttacatccccgggagcctctacccccaatcagcaggatttttggaattgccgaatccccccgctga

SEQ ID NO: 16857 - DNA, 479 bp, Homo sapiens
tttgtctttaaaattgcttgaggaaaaatggttgtaattaatttctgctacagaaaagccacctggtaccgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataattttttg

SEQ ID NO: 16858 - DNA, 384 bp, Homo sapiens
ggtttgagttaggattaagtaaaactacagtcttttttctcaaggaacttacatcaagcagaggaaatgagacttaaatataataatcaggactgggcatggcggctcatgcctataatcctagcactttgggaggctaaggtgggtgaattgcttgagctcaggagtttgagactagcctgggcaacatggtgaaactccatctctacaaaaaatacaaaaaattagccaggcgtggtggtgcaggcctgtagtcccagctacttggggagctgaggtgggaggatcatttgtgcccagaggtcaaggctacagtgagccgagatcgcgccattgcacactccagcctggatgacaaagtgagaacctttaccgaaaaaaaaa

SEQ ID NO: 16859 - DNA, 133 bp, Homo sapiens
aaagccaattacgagcactcacatccatattgacaggcataaatgccatagactacacaccgcgggaacgtcggtgagagccaggtcatatacacttcctggacctgtgagaaatatctgggctaatacaaaa

SEQ ID NO: 16860 - DNA, 366 bp, Homo sapiens
gacacctacatatggctgcattccatacctcagtgaagaagccgaaggatgttgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgcaaaatttaatgtttcataataaaaatagatacgttgactca

SEQ ID NO: 16861 - DNA, 508 bp, Homo sapiens
atatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagagcctcaatgatgatcactttgaattgcttgtgatttcaaaaataaagcagtgaagcta

SEQ ID NO: 16862 - DNA, 384 bp, Homo sapiens
ctctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacattgttgagtaaacctccagactttctctaaaaa

SEQ ID NO: 16863 - DNA, 693 bp, Homo sapiens
ccggggcccttgactttaaaaaggctttcttttatcacttgcatgaatattgctgtgacacctaataaaaatttaattaaggcttagatgatatcacgttttatgtaacctggagtccttaaatccatgaaatcactcaaatagaatcaagtttgttggaaagagaatctcatcttaagaagtggcagcaggaaaaatgagtaagttccattttattttatcagtgaagtctggggctacgaaatggttctaacagcataaagaaataacagctgcattcaagaccaggatatgtaaaataatttgtttagtttcagccactttttaaagtcaattttacaccctgaaagaaaggcaatcctgactccattgtctttcgccaataaggagatcgggaattacaataataaatagaagaaagaatgttgtttttcctcactgtaattaattttatggctcttgcgaagatgaatttttgtggtgattaaaatagtcccttgcacatattaggtactcagtaagcatttgggaaatagggactttctagcctttatttgtggttaaggaatcagggaataaggtccaaaattgccttcaagaaattttgggacctccttctcactaagaaccgtaaggcctataaaagagacatttttattttctccaagtatgcctgcgagggggaattgaagg

SEQ ID NO: 16864 - DNA, 501 bp, Homo sapiens
agtattaacatggactaatctgtgggagcagtttattccagtatcacccagggtgcagccacaccaggactgtgttgaagggtgtttttttttcttttaaatgtaatacctcctcatcttttcttcctacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgtaggatatggaagacacagatgatgatgatgatgatgatgatgatgatgatgatgatgatgatgaggacaactctctttttccaacaagagagccaagaagccatttttttccatttgatctgttccaatgtgtccatttggatgtcagtgctattcacgagt

SEQ ID NO: 16865 - DNA, 388 bp, Homo sapiens
actccacctcaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatatagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaaaaaaaaaa

SEQ ID NO: 16866 - DNA, 308 bp, Homo sapiens
gagcccaggaattcatgaccagtctggacaatacagtgagacccccatctctggaaaacaatttaaaaagttgctgggattggtgcggcacacctgtagtcccagctgctcaagaggttaaggtgggaggattgcttaaatccaggagtttgaggttgcattgagctatgattgtgccacttcactccagcctgagtgacagcaagaccttgtctccaaaaaagtaaaaagaaaaagaaattaccaggcattcaaagaagcaggaaaatgtgacccataatgaggaaaaaaaaaaaaaaaaaaaaaaa

SEQ ID NO: 16867 - DNA, 371 bp, Homo sapiens
tacaaccaataccacagaaataccaaagatcactcaaggccactatgaacacctttatgtgcacaaactacaaaacctggaggcgatggataaatgcctggaaatatacatcccttcgagattagaccaggaagaaacagaagttctgaacagaccagtaacaagcagcaagactgaaacagtaatttaaaaattgccaacaacaattgtccaggaccagagggattcacagctgaattctatcagacattcaaagaagaattggtactaatcctactgaaactattccaaaagatagagaaagaaagaatccttcctaaatcattctatgaagtcagtatcaccctaataccaaaaccaggaaaggacat

SEQ ID NO: 16868 - DNA, 494 bp, Homo sapiens
ctgcccctcccaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtgccaaggtcaacaccctgattcggctgatggagagaagaaggcatatgttcgactggctcctgattacgatgctttggatgttgccaacaaaattgggatcatctaaactgagtccagctgcctaattctgaatatatatatatatatcttttcaccaaa

SEQ ID NO: 16869 - DNA, 164 bp, Homo sapiens
gaataagcctgatatggtgtagcatgcacgggaccccagcgactggcgagggggaaacaggagaattgcttgaacctggaaggcggaggttgccgtgagccaagattcgccattgcactccagcctaggcaacaagagcaaaactccatctcaaaaaaaaaaaa

SEQ ID NO: 16870 - DNA, 492 bp, Homo sapiens
tgaggttttagtaatcacatttgactccctgaaattggcaattttattcaatgtaggaatattatcatggtatattatagtgaggagcacatagtcattattattttgtttttgcaaatttattttgaaaaaaaggagcattatcaaatattggtttactattttaaagtaattcatcaggaaatgattttttaaacactgtccctttaagtaaatgtcccttgcttttcaaagctcaacttattacttatggtaatagagttactttgcttcttaaaacaaagtttatactagagcatagcattgtagaattattcaggtctcaatttctcactggaaaatgagtctttaaaatagtaaggatttaaatttctataaaatttaatcacagatacttatattttaagataaatgtgtggagctaaactctggaattattaaaatataaaacattatatccctctaatgtatttttcctatttaaatttaaac

SEQ ID NO: 16871 - DNA, 320 bp, Homo sapiens
atgtccacagacacatgtgacaggaagaagtattttgagcataagaacttggttcctggccgggcatggtggttcacgcctgtaatcccagcactttggaaggccgaggaaggtggatcatgaggtcgagaccatcctgccaacacggtgaaatcccgtctctactaaaagtacaaaaattagccgtggtggcgcatgcctgtaatcccagctctccggagctgagcaggagaacgcttgaaccaaggagttggaggttgcagtgagccaagatcacgccctgcactcgagcctggcaatagagcgagagtcctcaccaa

SEQ ID NO: 16872 - DNA, 110 bp, Homo sapiens
aattagtacccagcccaacttgaaaaccctagtgctagttcttgtatccccaaaaggtcgagtctttttggcgagtcttacaagtctgatatgcagtccagaaaaacaac

SEQ ID NO: 16873 - DNA, 631 bp, Homo sapiens
tcgccatcctgggtatggctgaaacttatgaatcatacataaaagcttgactgcgtggaccatatataatccgtgttttaaacgtcttgatatgctgaggaagtggcaaatccttccgtgtcctttgaggtcattggtttaggcctgggaaatgttgaggaattttgtggaatttgtggagcctctgtattatgtaatgatgtaggccatttctatggccttctgtgtaattcacaccccctggcaccacactctcttgaagatccttcaggaatcttatattttgctgaacagtggcaaatgctttggccctaatcaagggcctagtcttatataaaacttttgtgtggcaattactaaaaacacaagatcttaattactgtagcacaacaattatcctactcattgtatcttataagaaggattgtgatagcaatgttgccagggtaatatatttccctatgcaaagaattaatctgcaaatatatggtaggaacttcttgatattaggaagggaagaggcaggtccgaacccggaatctccgttcaagtcaccaatgagaagagctggggaaaaatgaaattcactagagcagacccttcaattttgggagaaaagcttggatccttt

SEQ ID NO: 16874 - DNA, 352 bp, Homo sapiens
taatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaatt

SEQ ID NO: 16875 - DNA, 402 bp, Homo sapiens
aatggaggtcttatattacttgattttcagactacattattcgacactgtggtattaccacaaggatagacatggggtcaatcacagacactcacacttataattccagctctttggcagaccagggtaggaggattgcttgaggtcaagagttcgaggctgcaatgagctatgatggcactgctgcactccagcctgggtaacagagtgagaacctgtctaaagacagaaacaaaaaatgatagacacagattagtggaatatattaatgagtctagaaaaagacctatacatttctctctaattggttttcaataaatgtaccaaggcaatttattgggggtaacagatgcttttcaataactgttgctggatcaagtggacattcatgtgcaaaaaaaa

SEQ ID NO: 16876 - DNA, 140 bp, Homo sapiens
agaagaaggaaatagaaaaattacaagaaacaataaaggttttggataatgaacacccaatctaccaaaacctgggggaatacagcccaagcagcagggaacagggacgcccgcagctcttgacgcctacacccacggga

SEQ ID NO: 16877 - DNA, 363 bp, Homo sapiens
ctatggacaactaattaattttactttttatcctctgagatttgattgtggagcggcataagggggagaaagataagttgaggacgtctctttatcttttgttaatcagaggtggtgatagagtggaaaatataacacgtttcggcattcaggagacctaccttccaatgtaaataagcccttgcggtcttgatattttattccttttgtaccttcatctcataatctgtatgaagactttagagttccaagctcttaagatccctattagctctcaaattgtgggataaaaataattgtaaggcatgcctaatactcttatacagactttgtaaactgatttcagagaagcgattaaggaat

SEQ ID NO: 16878 - DNA, 176 bp, Homo sapiens
acaaagaagaagaatcattctattgtaggagatgacagcttcatgagggttatagcccttgaagacctttcagtgggacaaaatatgggggtggaaaacagggatattgatgatgctgaccctgggtaggcctagactaatgggtgggcctgcgcatcatttttaataaaaagact

SEQ ID NO: 16879 - DNA, 490 bp, Homo sapiens
caatgaggggaacacaaggaggggaactttacacacccgggcctgtcaggggttgagggggttaagggaagggggagcattaggacaaatacctaatgcatgcgagacttaaaatctaaatgacgggttgataggtgcagcaaaccaccatggcacatgtatacctatgtaacaaacctgcaagtttgcacatgtatcccagaacttaagtttaaaaaaaatagtcagatattggcaatttcatataattgaacttaattactgtagcgtaagtctctaccaatttcctccctactttctcctttcatgctattatgaggacataagaaaatccttggagacacacactacattccagcattaatggaaagaccctacaagaaaagtaggtctccgagcagaactcaaggaaatagagacacaaaaaaccctcaaaaaattaatgaatccaggagctgggtttttgaaaggattaacaaaattgatagac

SEQ ID NO: 16880 - DNA, 472 bp, Homo sapiens
acaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcatgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgttgttgttgatgatgaaataaaaatgctagcgacagtctttcttactggtgct

SEQ ID NO: 16881 - DNA, 502 bp, Homo sapiens
tcaatctggttaactttggaatcgcatgggaatacgcacattaagttcctttctaaaataaggttttatgaagctgagtttcacgataagtgtcttgctattttttgagatgttttatggacaaaggaaactttacagatttatatgtattttgctgcaccagtaaatggaccattaactagggcccacctttaacagagcacccctttgaaggttttataggtatgaaatatatgtagatatttgtaaagggttttaatttttttttttgatggggtgctgggtaaatcttgtatttataaatgtaatgaaggtattgacagaaaaaaatatatacaacttttataaaggattgtgtcctgactgaatacatttaaaagaaaatatattttgaaacctgttctgctatgaacagagataacatatctttttactatgctattgggttttagggttaagcctcctaatgcataaaaaattacagggggtactctaaaaaaaa

SEQ ID NO: 16882 - DNA, 465 bp, Homo sapiens
tctgaatttgaatataaaggagcttaggtgctataatctgaatggaacgtgggaataaaactgtctttgccttgtacttcttgttagattaattaaataccaattatcagtataagaaaatggcaataaattgtcaaagtggaattggaaagtgtttttaggatttggatatgaagcaggcttcccatgtgaccattctcacttcttattctgaagtctaacactctgcttttctttctctccctctcttcattgattcttctagtggctggtgtttgggtattgtgggaactgagctttcatctcctatgttagtcatagagatgagggctttgagggcaccatggaatccgattgctggaaataaatcaatcttaaaggaaaggaaaatttaaaaatcaggtgcaacaaaagcaaaatgagaaaactgctaaactctacaattctataaagaagaattgcctt

SEQ ID NO: 16883 - DNA, 308 bp, Homo sapiens
ggagaggcaagtcccagttgaatgtcatcccgctttctggggcacggcggaccgctctcgcccttggaggtgcgttgacgtggaaggtgaatgtctcttctgcgtgacagtgcctcagcgcacgggcgacgaggggcacacctatccccctggctcgctctctagctggattcaggtggaacggaggaccatgaaccctctggaccttttctgccttggtcctatgcttgtaaggtttccggcctaagaggcccatcgactccttctgccttctttcagttgattacaaaataaataaataaataaat

SEQ ID NO: 16884 - DNA, 372 bp, Homo sapiens
cctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctaaaaaaaaaaa

SEQ ID NO: 16885 - DNA, 228 bp, Homo sapiens
gccgctattaaaggttcgggtgttcaacgattaaagtcctacgtgatctgagttcagaccggagtaatccaggtcagtttctatctacttcaaattcctccctgtacgaaaggacaagagaaataaggcctacttcacaaagcgccttcccccgtaaatgatatcatctcaacttagtataatacccacacccacccaagaacagggtttagaaaaaaaaaaaaaaaa

SEQ ID NO: 16886 - DNA, 530 bp, Homo sapiens
tttcagggaaattaatcaagtacctatattgacttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaataatcattttcttcagacttgaaggagagtgataa

SEQ ID NO: 16887 - DNA, 608 bp, Homo sapiens
caaggtgtaggctggggctcaagtctttactggggagagatttgcttccaagctcactcttgtgactattggcctgagatgtcagttgccacatgggactccccatagggcagctggattctctcagagcaggagggtacctaaaataacaccatggtcttttcgcaacctaatctcagaaatgacagccaatcactgttgctgcattctatttactggaagtgagtcactaagtccagcccacgtacaaagggaggagactgcacaaggaagcagtcattggacatcatcttagagaaggcccaccatggtaaatgtatttccttaaactgagtatataaaaatattattttaacatgtagtcagcatacaataattaccaatagatatttaataccttttactaagtctatggaatatagtgtgtattttacacttatagcacttctcaactcagatgttatattttcattggaaatacccgactgtatttagatgtcatgaaatttatacttgaaaaaatagatctggccagcacggtggctcacacctgtacttcagcactttaggaggccgagcaagtggacatttgagggtaggagtcatga

SEQ ID NO: 16888 - DNA, 447 bp, Homo sapiens
gaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagtataactccaaa

SEQ ID NO: 16889 - DNA, 391 bp, Homo sapiens
cagagcataagcacatccaggttgtctaccttcataacaacaatatctctgtagttggatcaagagacttctgcccacctggacacaacaccaaaaaggcctctcattcgggtgtgagtcttttcagccacccggtccatgctgggagacacagccatccaccttcagaagtgtgtaccagcgctctgcattcaactcggaaactataagtaattctcaagaaagccctcatttttataacctggcaaaatcttgttaatgtcattgctaaaaaataaataaaagctagatactggaaacctaactgcaatgtggatgtttacccacatgacttattatgcataaagccaaatttccaggttaagtaatcgcctaccatgcaccctcaggg

SEQ ID NO: 16890 - DNA, 416 bp, Homo sapiens
acaaacaggattaaactaggtttggttccttcagccctctaaaatcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgttttgtaactcctgattcttccttttcggatactattgatgaataaagaaattaaggcc

SEQ ID NO: 16891 - DNA, 521 bp, Homo sapiens
tcacccagggtgcatccacaccaggactgtggggaagggtgttttttttcttttaaatgtaatacctcctcatcttttcttcttacacagcgtctgagaacatttacattatagataagtagtgcatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgatgaggacaactctctttttccaacaagagagccaagaagccattttttccatttgatctgtttccaatgtgtccatttggatgtcagggctattcacgagttgtacattgctcaagatttagggtttgacctcagtcccaaccaacattcattttgatactcgaa

SEQ ID NO: 16892 - DNA, 144 bp, Homo sapiens
cctgccatccatgaaaactggtctggcaccaaaagtaatgacaaatgttaagtgtaataatagaaaagtagagcaaagagccattcagcttcagtctttacataccatgaataaaacattaaaacatcaaaaaaaaaaaaaacc

SEQ ID NO: 16893 - DNA, 600 bp, Homo sapiens
  misc_feature 2, 4, 5, 6, 7, 8, 9, 15, 16, 17, 20, 25, 26, 31, 32, 42,46, 52, 55, 63, 82, 105, 138: n = A,T,C or G
gngnnnnnnggggtnnntcntatgnnaaganntcggccttantggngaaatngcntccgagcntaacccaggttaacttgcnagcagaggcgggatactttcttntttccatgtaactgtatgcataaagccaatgtngtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggttttcatggcaacttgatcagtaaggattcacctctgtttgtaactaaagccatctactatatgttagacatgacattcttttctctccttcctgaaaaataaag

SEQ ID NO: 16894 - DNA, 161 bp, Homo sapiens
aaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaaaaaaaaaaaaa

SEQ ID NO: 16895 - DNA, 487 bp, Homo sapiens
  misc_feature 5, 6, 7, 8, 9, 14, 16, 22, 26, 27, 45, 46, 48, 53, 54, 55,62, 73, 81, 82, 90, 93, 103, 105, 106, 118, 130, 145, 153,161, 170, 175, 179, 182, 184, 186, 193, 196, 198, 199, 201,210, 214, 218, 219, 223, 224, 228, 229, 230, 236, 244: n = A,T,C or G
  misc_feature 249, 250, 256, 267, 272, 273, 278, 293, 299, 325, 330, 338,339, 340, 341, 342, 344, 345, 346, 350, 352, 353, 354, 356,357, 358, 359, 360, 361, 362, 364, 367, 370, 372, 378, 383,384, 389, 390, 392, 393, 396, 399, 401, 405, 406, 407: n = A,T,C or G
  misc_feature 410, 412, 419, 421, 427, 431, 433, 435, 442, 444, 451, 455,457, 458, 459, 461, 462, 464, 481: n = A,T,C or G
cgcgnnnnnagggngnaagaanccannaggagggactctcggccnntntgggnnnggatccncaaacacaaancataacannaggcaaanaanacagccaacntnnagaaggaagaanttggccactatntgtaggaaatatganatcagagnaaaaaaanaaaaagganaaganacanacntngnggggcgnggngnncntcacctacncaancctnngcanngttnnncccggnggccccantaggnncccccngggccattccncccannggggncatctgttttcaggnatcagnacctcaagagattaaacatgataatnaaagngagagccnnnnnannnaccngnnncnnnnnnncnccnggngnccccgnccccnnggganncnnaanccngnggannnctngncccggangntcaggncgcngngnccaaggncnccccagngccngnnncnngncacagctgagaccctgnctccaa

SEQ ID NO: 16896 - DNA, 361 bp, Homo sapiens
gaccaatggaacagaatagagaacccagaagtaaataaatttatttacagacaactggtttttgacaaaggtgccaagaacacactctggggaaaggacaccatgttgaacacatcatgttgggaaaacaggatatcatatgcagaagaatgaaactatactatctctcagcatataaaaaaatcaactcaaaattgattagagacttaaacatgagacctgaagcaaacagtactagaagaaaacagaagggaaacccttcaggatgtgggtctagcgaagattttatgggtaagactttataagcacaggctcataaacaaaaatagacaaatgggactgtatcaaactaaaaaaaaaa

SEQ ID NO: 16897 - DNA, 577 bp, Homo sapiens
aaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggt

SEQ ID NO: 16898 - DNA, 499 bp, Homo sapiens
ctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccaatatttttatacggaaaaaattgtattgaaaacacttagtatgcagttgataagaggaatttggtataattatggtgggtgattattttttatactgtatgtgccaaagctttactactgtggaaagacaactggtttaataaaagattacattcc

SEQ ID NO: 16899 - DNA, 342 bp, Homo sapiens
cacgcctggccgaaaatagcatcttcatccacttttatctaagcttaacatctattctgtttatggtgttgcagagatttggggaactgggataatgagtttgtccatttcaactgttgattattttactaatggctatgaaagtgctatgatgttcagagcaggtcttttcacatttgatggataattttgggagcagggaagatagaccttatttccttgcttagagttcatttcaaaacatggattttagatataggactgccagtttagcaaaataaaaatatgagacatgcagtaagtctgaatttagctagacaataaataattttagaatattag

SEQ ID NO: 16900 - DNA, 320 bp, Homo sapiens
cagagaacaaatagatgactggaattagacattcagaaaagaaacacatgaatacccgaaaacttagtagacgatataaatggcattacaaatcagtgattgtgctgagacccagtgctactcatatgaaaaaaagaaaattcgatacctttttaagataataactatagttggattaaaacccaaaatgtataaagcaagcatttatgactcctagaagaaaattgagagaagggaattctttcttaaggcaaatatatataagccataatggaaaaaagtgattaaaaatgaatactttgaagttttaaatgtctgca

SEQ ID NO: 16901 - DNA, 414 bp, Homo sapiens
ctggtgtgtcacacagactcctgtttcctctccactctttccttgacaagatgggaagaaaaccccagtggtcctttctgaaataaaaaaccaaaatggcagaaggaaatggataaggagaaggtaaaatgtaaagaaagcagcaacagccatctgccattctcttgatcccactgtggttctgcccatcacagagtctgtgggcccctcctggagaagaaggtagcagtggcttcctatccaggaaggctgcagtgtggcctcttcccagctactggccagagccaaattgtttgattcagaagtccctggtgtctcttagcagtctgagagagacacatggaaacatggttagaatgtattcagtcctgaacctttcaaatgtttcacaaaataagtttatgaatttgatcc

SEQ ID NO: 16902 - DNA, 456 bp, Homo sapiens
gaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcatttttattattttctatgtaacttttaaaaatcaaaatgatgaaatcccaaaacattttgaaattaaaaataaatttcttcttctgctttttcttg

SEQ ID NO: 16903 - DNA, 506 bp, Homo sapiens
cttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtactataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatgagaaaacctgacgctatgattactatgccttttctaaagatcaatactataacat

SEQ ID NO: 16904 - DNA, 509 bp, Homo sapiens
gagcaatcagcagtatatttataaacaggaacctgtacagaagtgccctggaagagggcctgctctaaattatccagtgtatggagaaacgacacagggtaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaatttgacactgaaaaacatttattaataaagaatattgacatgag

SEQ ID NO: 16905 - DNA, 513 bp, Homo sapiens
cgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgtctttatattcgtcatgtcgagtattgatgctttctgactggtacacgatgctttacaacccaagtccagattacgttaccacagtacactgtctcatgaagccgtctacccactatataccattgtatttatctattacgcatcctgct

SEQ ID NO: 16906 - DNA, 518 bp, Homo sapiens
atggccgggagcaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttctt

SEQ ID NO: 16907 - DNA, 250 bp, Homo sapiens
ccgtgccgggctcttcgtgcacgccaaggaaccccaattactgggggcctacgagaagcccgcactgcgaacgaggaggagcaaggtctgtggcaaggccaggaagggcctacgctaaccactgaccccaccggaagaaacgagcagtggcatctctgagactcacaacctagagcccacccgagacacgatggcgtgcaccaagacgaccgcttcagcgcctgctctgatccttacttgcttcaacaga

SEQ ID NO: 16908 - DNA, 389 bp, Homo sapiens
aaaaggatatcataataaattattatatagtaaaaattaaccagactgttctaagaaatggaatgtaattagattaattaaattgtctggctaattgggtactaaaaccggaaaatccttgttgttcttgttcttgttaaaaatacatatgccaaaaataatagaaatgtccttttgtaattgaattttgtagcacttgaataagcatcaaggttttcctataggtatagaagatttggttgattatttgtgtgattcttttatgcataacctaaatggttatgtatacttgatgtcgagaatttgggaagtcctctaggacaagagtacagatgatattataaattctgttatgagaaatgctatcaagggcaacctttatcaccaca

SEQ ID NO: 16909 - DNA, 452 bp, Homo sapiens
cttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggcaaagaccgcaaaaagatcctcgaacggaaagccaaatctcgccaagtaggaaaggaaaagggcaaatacaaggaagaaccattgagaagatgcaggaataaagtaatcttatatacaagctttgattaaaacttggaat

SEQ ID NO: 16910 - DNA, 322 bp, Homo sapiens
cacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgtttatctaat

SEQ ID NO: 16911 - DNA, 632 bp, Homo sapiens
aacattctttaaagcaaacacattgaaaatattattacaggcagaaccctgatttttaatttatattccctgctgcagacattagccttctttaattcttttgccattacatacatgtttcggctacagactgaacacgaactaaagtccctaaggaggaaaaaaccttaacatattcctgagatgtgattcttttattacttctttttgcaaagctaattatcaaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaatgtgttcctccttgttggagacattagccagtgtttagttttagaccaacttatacaaagagagtattgatttgtacacattctggagacttgctatatcatggtttgctatggcacagactcagcttagcatggggacattttgacctcattcaaagtggagtaggtaccggaacctttgacattgccttgtaatgaggtccttccaaaaaaagacccctaacaatggcataa

SEQ ID NO: 16912 - DNA, 230 bp, Homo sapiens
acccccccgacaaccgggggcggagcagcacgatgaggcacggcaagcccatgagccacgcctcccggcggattaccgaacaagatgaggccacactagacgatctgcgcagaccggatcaaaggactgggacagctgtgcatagacagaggagccaaggaggagcctgctaagcgaagaaatgaactacaagggagcgacagtgccacacaaacaactaataaaggaag

SEQ ID NO: 16913 - DNA, 478 bp, Homo sapiens
agaaatgatacctaaactaaattcaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataaggtacttgaaataagttgtttcagataaatttcaattagatttaaaataacattttgtccaccttttaagttaatgaaataaaatttgaaactgg

SEQ ID NO: 16914 - DNA, 538 bp, Homo sapiens
cttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactggttaataagcatattttgaaaatgtatggctagagtgtcataataaa

SEQ ID NO: 16915 - DNA, 300 bp, Homo sapiens
acccaaaaaagcctatgacatggagcacactttctacagcaatggagagaagaagaagatttacatggaaattgatcctgtgaccagaactgaaatattcagaagcggaaatggcactgatgaaacattggaagtgcacgactttaaaaacggatacactggcatctacttcgtgggtcttcaaaaatgttttatcgaaactcagattaaagtgattcctgaattttctgaaccagaagaggaaatagatgagaatgaagaaattacccacaactttctttgaacagtcagtgatttggg

SEQ ID NO: 16916 - DNA, 119 bp, Homo sapiens
tataacctcttaggttgtatcctttaatttccagccttttaggttagtttctgtaacagaacaagtgagtctgggatgaagtcctcaaagcacttcaaatggtgattgttttgtttttg

SEQ ID NO: 16917 - DNA, 215 bp, Homo sapiens
gggaggcgctcaagaccagcctagacaacatggcaaaaccccgtctctgccgaaaataaaaaaattagctgggcgtgtaggcccagctactcaggaggctgaggtaggaggatcacttgagcccaggaaacagagattaccgagagctgtgatgcaccactgcactccagcctagatgacagagcgagattccgtctccaaaaaaaaaaaaaaaa

SEQ ID NO: 16918 - DNA, 141 bp, Homo sapiens
gatgttaagggatgcttcaaaaactctgtaaattgtttattctaaactgatctggctgcaaattgtgctgattaagaattgtgatagttcagcctgaacgtctcttagagggtgggcttttgttgatgagggaggggaaac

SEQ ID NO: 16919 - DNA, 513 bp, Homo sapiens
tttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgt

SEQ ID NO: 16920 - DNA, 552 bp, Homo sapiens
gggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggaccagtgttctgatttggaaaaatttggtctggaaattccaagagcattacacttagaagataaatctccagaaagattgaagctcagtggatgggccaaagggaatgaactcagtttacatggcagctcattcacattcctccttt

SEQ ID NO: 16921 - DNA, 642 bp, Homo sapiens
ggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggtgcttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgctttactaaaccgcggacgaaaatggaaagattaattgggagtggtaggatgaaacaatttggagaagatagaggtttgaaggggaaacctggaagacagaagt

SEQ ID NO: 16922 - DNA, 544 bp, Homo sapiens
tgagatgtatagaaatcttgctcaaggaaggaatgtgaagagtcggaaacttaaagaaatatttaacaaagctttggttgatccaggccctgattttgttgtttgtgatgaaggccatattccaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggacagtgtgcagattctaccatggtagatgtcagagtgatgaaaaaacgtgctcacattctctatgagatgttagctggatgtgtcagaggaaagattatacagcattacaaaattcttgcctccaaacacgaatatgtgttagctgtgagaatgacttctattcagtgcaagctctatcagtactacttagatcacttaacaggtgtgggcaataatagtgaaggtggaaga

SEQ ID NO: 16923 - DNA, 466 bp, Homo sapiens
gcgcgccgccacaatggtgcgcatgaatgtcctggcagatgctctcaagagtatcaacagggccgaaaagagaggcaaacgccaggtgcttattaggccgtgctccaaagtcatcgtccggtttctcactgtgatgatgaagcatggatacattggcgaatttgaaatcattgatgaccacagagctgggaaaattgttgtgaacctcacaggcaggctaaacaagtgtggggtgatcagccccagatttgacgtgcaactcaaagacccggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttcaaaaaaaa

SEQ ID NO: 16924 - DNA, 266 bp, Homo sapiens
gagcgcaagcgatccacctgcctcagcctcccacattatgggattataggcatgagccaccatgcctggccttgtactgcacttgcaaagaattgaaaatgcatttcatgtataaatacatttgtattgtcggtacaatatcttgttaataatcaaacacattgaaatcaaacacattggattctcaccagttttaatttgaccaacatagtcaagaaaacaattttcctataaagtgccctgcagctctgaaattctttaaacta

SEQ ID NO: 16925 - DNA, 593 bp, Homo sapiens
aggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcagtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtggtttaaaaaaaa

SEQ ID NO: 16926 - DNA, 495 bp, Homo sapiens
ttatagattatcccttatccaaaatgcttaagaccagaatgtttgagatttaagaaatttttcaggttttggaatgtctgcatatatataatgagatatcttggggatgggacccaagtctaaacacaaaattcatttatgtttcataaatgaaacttaatgcacatagcctgaaggaaattttatttttcccttagggatgttgaatcaactgttgtgtgccagcatgttgacaatgacctgtcacatgaagtcgggtgtggaattttccacttgtgcgttcatggcggtgctcagaaagtttgggattttgaagcattttatatttcagattttcacattagaaatactcaagctgtccttgctcacagtggccaaaaaaaaagaaagaaagaaaagaaatactcaaccagtagtccagtagtagttatcactagaaatgaatgaaaatctattgcagtattattgagttttcctaatattccagtgcaaaaa

SEQ ID NO: 16927 - DNA, 541 bp, Homo sapiens
tcaactcggaaactataagtaattctcaagaaagccctcatttttataacctggcaaaatcttgttaatgtcagtgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgcaatatttagtaaagctttcttttttaatttccaggaaaaaataaaaagagcatgagtcttctgtaatcattgagcagttagctcatttgagataaagtcaaatgccaaacctagctctgtattaatccccatcattactggtaaagcctcatttgaatgtgtgaattcaatacaggctatgtaaaattttactaatggcattatttgaaaaaataaatttaaaatacattcc

SEQ ID NO: 16928 - DNA, 386 bp, Homo sapiens
tattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgaaaaaaaaaaaaaaaaaaa

SEQ ID NO: 16929 - DNA, 359 bp, Homo sapiens
gaaagatatgagataggtcttacacacaggtatggctctctctggaatctagaaagaatcatcttaattgccctatgggggaagtgaagagttgagggagagaagaatgtcttagacagtgggacatgagaggggcgtaaccctcaggtagaggactcaaaataaaatgttgagtatacatttttacagtgattctcaaacttttctgtgcaataatcatctgagtctagtgtgagtatttatattttctgggcctacaccagaatccgagtcagtaggtccgagatggcgttcaggtagtctctgggaggatcgctgttttaggaatagtagttttatagtgaaatttgaagctaaca

SEQ ID NO: 16930 - DNA, 127 bp, Homo sapiens
gctgaatttctagacaataatggcaataaaaactttccgtatcatgaatccatggatacagctaaaggagtggtcagcggaaagttcatagccttaaaatacttacattacaaaaaaaaaaaaaaaa

SEQ ID NO: 16931 - DNA, 231 bp, Homo sapiens
atgtgaggccgaggcgcgcggaccgccaggacaggagaaggccgccgtggggaaccctggtctctcccaagaaaatctaagaagtatccgggcctggcggagcacgcctgcagccccagctactcgggaggttgaggcaggagaattgcttgaacccgggaggcggaagttgcagggagggctgagatagcaccactgcactgcagtctgacaacagcaagactccatctc

SEQ ID NO: 16932 - DNA, 503 bp, Homo sapiens
atttttgttttcatccatttttaaatgtcttttataaatgtatttcatttgtaatcctgctttttcattttaatgaagaatttcattttcttactgttttggttttgttagtcatgaaattttttttaatcataataaccctcctgggaatttatcataaggaaatagtcaaagaaagaaatgctaatataaaaagacatttatagctatagttatagtaggaaaattattcccaccgtaaatatataactccccaaattaaaacaactgaaaacactgtataggaggggagtgataaactataacaaatcagtattaaaaaattatgtatctcctatagatttatagattataagatatttacataggaatgaggaaacctgttttatgtcataagtatatgctactaaattgttacatataagtggctaaagattagaagggaacaaaaaatgagcatggtattattttagaatggtaggagtctgagtaaagtaaaatct

SEQ ID NO: 16933 - DNA, 371 bp, Homo sapiens
caaggtcataagggagacaaaagtgagagatgagggcagaggggtcctagaaggccagatcacataggacctttagttcagagtaaggactaacttttaccctgagatggggtaaacagcaatgcacataatagtcatcaagtaatattgatgctcagatatgaactttatttctctctcaacatttcagtaaaggaatttatgattcatatcttatgtaacaaagaattaagatcttttataaataaaggacatttacaaatctataagcaagtatcccaaataaaatgtgaactaaataggcaaaacaataataaatataaatataagccatgaaaataaaatattactttactagtgcgcaaaaaaaa

SEQ ID NO: 16934 - DNA, 410 bp, Homo sapiens
aatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgacatgtctcccatcagaaagattcattggcatgccacgggattctcctccttcatcctgtaaaggtcaacaataaaaaccaaattatggggctgcttttgtcacactagcatagagaatgtgttgaaatttaactttgtaagcttgtatgtgg

SEQ ID NO: 16935 - DNA, 569 bp, Homo sapiens
gttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaa

SEQ ID NO: 16936 - DNA, 161 bp, Homo sapiens
cttttgagaatatactctgattaaaatgtgaaagatgggatcgacaactcattgctatcctggaatataatgttaatttattgactagtttgaaataatgtgaagtgttttttatatcagattaatataggaaatgtttattcttgaaaaataaaaaaaaa

SEQ ID NO: 16937 - DNA, 308 bp, Homo sapiens
tgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatgggaaaaaaaaaaaaaaaaaaaaaaaaaaaaa

SEQ ID NO: 16938 - DNA, 522 bp, Homo sapiens
gagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggattttggtataattatggtgggtgattatttttatactgtatgtgccaaagctttactactgtggaaagacaactgttttaataaaagattacattcccaaaaa

SEQ ID NO: 16939 - DNA, 269 bp, Homo sapiens
acatcatcctaaaaggcaagattttcccacgcaggtgacaaggtggtttatgtactatttaagggcggaaggtgcgtgcccgttcaataagcatgttttttgccaggtaggaaatatgttccatatctttacttatcattgcatttcagatgggaactagaaaaactggagagaaaaatgtaatgaaactgctgctgtaaattattccttttagcatgtattcacttgctaaatacacatttcttcaaaaaaaaaaaaaaaaaaaaaaa

SEQ ID NO: 16940 - DNA, 435 bp, Homo sapiens
gaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacgaaaaa

SEQ ID NO: 16941 - DNA, 211 bp, Homo sapiens
ttctgctgagggggcacttcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgagggaaaaaaaaaaa

SEQ ID NO: 16942 - DNA, 528 bp, Homo sapiens
tctggtgccaaagagaaggaaatagattaaccccagatacagggtacaatctcagaaagacaagctctagtggtacattaaaaaaatgcatggaacctttatgggttggaggttattttaaatgactttatactttttgaattaaaataagtatatttggggtacctgttataacaaaacacaatgtcaggtgcaaggaactgaaagacatattcagtattatgtctgcctgcatgtatgattactgatgccataattgtcattaattcaaaattccaaaagcaagaaacagaagtgtaggatgttgaatgcttctgcttagaagtggtattgaaaccattgaaaaaccacggcagaaattaaaagaatttcatgtgcacagcagacctgctcctgtttatgataatgcaaattagatgacttctgattcctgtgtgtgcaaatgaattttcgtttgtggcgtattagttatctttgtagcaacaagcatagctgtaagaatggtaaccattctcttctaaaatatga

SEQ ID NO: 16943 - DNA, 488 bp, Homo sapiens
cacgcttgcaacttcccttatggcattaatcttgttgagggagtgagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatactgcagagtatataaaacttgagacatttttgtaggatgcctgacgaggtgttgccttttatcttgtttccggatgcatatttattacgagtactctggttaaatattgaaaagtatatgctgtagttttagtatttg

SEQ ID NO: 16944 - DNA, 550 bp, Homo sapiens
gccggggaccttttataagccattgtgattaggatgactgttacaggcttagctttgtgtgaaaaccagtcacctttctcctaggtaatgagtagtgctgttcatattactttagttctatagcatacttgcatctttaacatgctatcataagtacatttagaatgattgcctttgattttttttttaaattctgtgtgtgtgtgtgtaaaatgccaattaagaacactggtttcattccatgtaagcattaaacagtgtatgtaggttcaagagattgtgatgattcttaaattttaactcctcacttaatatgcttgaactgtcgccttaactacactaaacaggataaacttttgactcccctttggtcatttggggattaaggggtataatacttaatttggcatttgactcttaagatatgaacctagctacttggggatggctaagaatattttctgatactggtcctttcctgcccctcctgcaacaaaagataggtgcacttaacccgattttttcctctttggggtatgccatccaataa

SEQ ID NO: 16945 - DNA, 546 bp, Homo sapiens
tttatgatgactcagtggtgccagagtaaagtttctaatataacattcctctcacttgtaccccactaaaagtattagtctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgcaaagttgacctcaagataacatttttcattaaagcatctgagatctaagaacacaattattattctaacaatgattattagctcattcacttattttgataactaatgatcacagctattatactactttctcgtattttgtgtgcatgcctcatttccctgacttaaacctcactgagagcgcaaaatgcagctttatccttttaccttcaattgcctagcacaatagtgaggacattgaaatgaa

SEQ ID NO: 16946 - DNA, 118 bp, Homo sapiens
tttggagaagatagaagtttgaagtggaaaactggaagacagaagtacgggaaggcgaagaaaagaatagagaagatagggaaattagaagaaaaaaaaaaaaaaaaaaaaaaaaaaa

SEQ ID NO: 16947 - DNA, 365 bp, Homo sapiens
gaagaaaaatttaatcagagttgtcactgcttctcaagaataaatcttcatatgaggttgctatatgaccaccaattatttaaaaccagttattttaagtaagaattaattaccttttcccaaaacattgatctacccatgcaaagaagacaatgcatcctgaaatgctgatgcttaagatagcagcccaaagtagtaaaatacagttaacagacataggaaaccaacactgttctgaagactgagtttttctttgcaccaaatgcagatggtagcttctagaaggctgtttgcctatattcttactcctgttgaatattgttgccatatatttagaacttcaagttattttctaaggaaaaaaa

SEQ ID NO: 16948 - DNA, 284 bp, Homo sapiens
catatgatctcactcgtaagtgggagctaagctttgaggatacaaaggaataagaatgacacatgggactttggggacacagggagaaagggcgggaagggggcgaggaataaaagactatacactgggtgcagtgtacaccgctcaggcgacggcttgcaccaaattttcccaaatcaccactaaagaacttacccatgtaaccaaataccacctgttccccaaaaaccttatggaaataaaatatatatatacataaaaaatatatcgagaaaaaaaaaaaa

SEQ ID NO: 16949 - DNA, 336 bp, Homo sapiens
atggatctatatttttcctataagacagctgtgtttagaattttgagtgtctttcctccccccaataaatttccttactactctttcttcatgaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagttttttttttt

SEQ ID NO: 16950 - DNA, 181 bp, Homo sapiens
gagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaag

SEQ ID NO: 16951 - DNA, 545 bp, Homo sapiens
cacgggtttggggacactgctgaaagcatcccagaactgaacagtgtggtcgagcattccaagtccgtgaaggtgcaggagcggtacgacagtgccgtgctgggcaccatgcacctgcatcacggctcctagagacgctgacctggctctcggaaacgcaggagtccttcctggtagccagctcagaatacccatgtagcagcaacttgaacggatgtcacaacttgtacgttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagttcttctgatgccaatctcaacattgtcttttaatactgtcaccaaatattgccatttttctttttgtaaaagatatatgatcaagataaattggggtggtaaatcaggtgcctggtaatttatctctttgcacatgggcatcattttaaaaagcttgcttccactcttttctg

SEQ ID NO: 16952 - DNA, 197 bp, Homo sapiens
aaagactgccatgatacaattacctccgcctgagtccctcccacacacgtgggagttctgggagatacaattcaagttgagatttaggtggggacacagccaaaccatatcagtaccctgacagcagaggcttccagtaggtgccaaacagggtcagttaagcagacatctctctaacagttatcaaaaaaaaaaaa

SEQ ID NO: 16953 - DNA, 545 bp, Homo sapiens
attcacatgcaattttaaaagatgtgtaactcattattagtcatcagggatatgctaattaaaatcaaaatgaaataccactatactaaatgtagacaaggatatgatgcaactggaactctgatactttgtggtacaactactatgaaaatgacatggctactttgcaaaaaagttgtaatagtttcttataaaactaaatttatacctatcctgtgacccagcaattttacatttatgtgtttactcaagagaaaaacacatctacaaaaaggtcaagaatgttcatagcagctttattcaaagtagtcccagactaaaaaaagcccaggtgtctatcagtagtagaatatgtacacacactggtataaatatacaatggaataatagcagtgaaaaaagtacaaactgatgatttatgcaaaacctggatgaatctttaatatgctgaaataagtcttttaaaacagagtgcatactgtaaattcaatttatataaatttctagaataaactaatgtacggtggaaaatatcagaagaatgg

SEQ ID NO: 16954 - DNA, 125 bp, Homo sapiens
cttttcccttcagctcgcttagatgttccaaatttagaaagcttaaggcggcctacagaaaaaggaaaaaaggccacaaaagttccctctcactttcagtaaaaataaataaaacagcagcagca

SEQ ID NO: 16955 - DNA, 350 bp, Homo sapiens
aaattctgttaaaaaggaagcccatttcacttttcaagtatgctttgtttcaagccatgaagacacacatgtagttttgtcacattctactagccaaaattttcaagaagggttaaaacaaagactggctagaaagataattattttgaataaatctcatattcatcttccatttatataattgttacttattcctcccatgcagtctcttcgttgtctttaagtgtgtgcctccaggcatgcttatttatttttattggctcaaggtaacatttaagatgtatattaaagtaaagctacatttttttacttcattattgcatttacagggatttaattgtactttggaa

SEQ ID NO: 16956 - DNA, 480 bp, Homo sapiens
  misc_feature 405: n = A,T,C or G
gtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctcccggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatggggctcttgttgaaatccgaaattcttgggtgaaaaatatatcccagggtcggatgaaaccaggtgntgcttgttcaggtatctcaagcccagaaagatgaattaatccttgaagaaatgacattgagcttgttcaaattca

SEQ ID NO: 16957 - DNA, 550 bp, Homo sapiens
agggacttttcacataggttatttgatttcttctttatatcagccttgtggaataaccagagcagatacgatagtgtccttccattttacagatgaggaaacttggattttatgttctatgacttggtcaagatctcatagtttaagaggcagaagtgaatttagaactgattttctaattcctgtttttaatttagtgtggactaatttcagagtctgaattagagatattaccgtcatagacagtgaataagaaacaagacattcgtgacttttaatgtattatgttgactcaatttgggccaaatactttgaagtaaatattaatttaatataagccttattgtatgaaatggtaagtaaaaaattattgtcatattatgctatattttctaagtaatatttgtcagtctgtaaaaattagtaaagaagataatatcttaaaaatattttaacattagctgcatccaatggtaatgtcttaaatatgtggaattaattgcatatacataatgggggtttcaagcgctatgtttgctaaatttcatta

SEQ ID NO: 16958 - DNA, 532 bp, Homo sapiens
ggccactgcgcagaccatactttgctcgtacttgtgcgcctcgcttcgcttttcctccgcaaccgtgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgctatctatctggctggcagggaaggaaagaacttgcatgttggtgaaggaagaagtggggtggaagaagtggggtgggacgacagtgaaatctagaagtaaaaccaactggccatgggtcctgcaagctgtaatgcagttaatcagagtgcca

SEQ ID NO: 16959 - DNA, 140 bp, Homo sapiens
agtcgctcggctggacaaactagcctttttgggagaagagcgggaactggcaaggggggagaagagcccatcgagcagcgggggcgaatcacccccgctgcaggaggatacagccaggaaggtgcccccaggcgggcaga

SEQ ID NO: 16960 - DNA, 138 bp, Homo sapiens
acattaagtgatgtcacacaaggacaaaatcacctaatgatgcatttctcagaacatatccccatcggtaagcaacataatgactgtactatggtagctgcccatcagaaccacagaagtgtggagagaggagcaatt

SEQ ID NO: 16961 - DNA, 322 bp, Homo sapiens
agctctgctcctgggctcaagcaattttcatgcgtcagctttgctgagtagctggggctacaggccgtgtgccatcatgcgtggctaattttttgtatttttagtagagacggggtttcaccatgttggctaggttggtctcaaactccggacgtcaactgatccacctgccttggcctcccaaagtgctgggattacaggtgtgaaccactgtgcctgcctgaaatgccacttttcgtttaaaaatgaaaattttaaaactgtattggtagcttataaaagtcaatgatgtaaaaagcatactaaaaaacaaaaacagaaa

SEQ ID NO: 16962 - DNA, 562 bp, Homo sapiens
ccagcgcaggggcttctgctgagggggcaggcggagccttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcctttagattaaaatgaaggtgacttaaacagcttaaagtttagtttaaaagttgtaggtgattaaaataatttgaaggcgatcttttaaaaagagattaaacccgaaggtgattaaaagaccttgaaatccatgacgcagggagaattgcgtcatttaaagcctagttaacgcatttactaaacgcagacgaaaatggaaagattaattgggag

SEQ ID NO: 16963 - DNA, 687 bp, Homo sapiens
cgggggaactaaaataatctgtattttatagaaaaatattggtaacaatagttttatggtttttgctaataagtcataaagccttaccttgtggtttttcatcaaatgtttctcatggttcccataaacagtgctggaacctggcaacctcacatgctttacctagatataattttcatttgactggtatagacaaaggcatacatctcataaaaagatcaaagccacttaaaggagataccattataatgaaaatatttgtgtaaccaaagataactaagtctcaaaagagagcccattctcagaagctgtgttcaacaccaagaaatgtccatgcagtaaatgaaacagaaagccctcaagattagcttcattgtttgtggatttgttgctgtaattaagacatgaaaaaaaatatatatgattttaaaaagagagcttagaaacataatatggtggggaaataaataatgtcacccatctccccaagagaagaggcagtcttagcttccattcctccaaatcaaatttggcctatgtcttaattattctgctagggaagaaatcattttccacatgattcatttttagatggaaaatgtcagccgaatgtcattagacttcatgctttcgcaaatcctgtcctttgggccgttaattccagattaacccatcattttatagaaa

SEQ ID NO: 16964 - DNA, 263 bp, Homo sapiens
gaaacattgtactcttcatttaatgcttgatttaagagcagcaaaaagcaatcccagcgctcatggaacataaggtcttaggtagggtacctgaaaactacagtgattattacatcgtttgctcataaccaagatagaggtatatattccagaagttttgggagtgctgtggaagtaaacctgatttaacgttgggttgggatagagttggcagagatttgctggaggagtagctgtgaggtgggactcaaaaaaaaaaaaaa

SEQ ID NO: 16965 - DNA, 256 bp, Homo sapiens
ggagagccaaagctaagacccccgaaaccagacgagctacctaagaacagctaaaagagcacacccgtctatgtagcaaaatagtgggaagatttataggtagaggcgacaaacctaccgagcctggtgatagctggttgccaagatagaatcttagttcaactttaaatttgccccagaaccctctaaatccccttgtaaatttaactgttagtccaaagaggaacagctctttggacactaggaaaaaaccttg

SEQ ID NO: 16966 - DNA, 286 bp, Homo sapiens
gggattttagaagacagtgtggcctgttcgacagtatggaatattctttacccatcagatatgatctgtatgtgattggaaggaaataaaccaactgctaacaacacttctctatagatgttcagattcagtaatttttgtatttttctctacacttttgttttttcaaatttcctagcacaagaagactttgacttactgcacatgtcattttaaatgacctttataaagactctatagaaacaatttgctatgtcatgaaagtaacaagcaaaaaaaaaaaaaa

SEQ ID NO: 16967 - DNA, 480 bp, Homo sapiens
tatgtcaacctgctgtaatgccaaaagtttgctctgtccacaatttccttaagacctcttcagaaagggatatgtttgccttaatgaatactgttgggaaaaaacacagtataatgagtgaaaagggcagaagcaagaaatttctacatcttagcgctccaagaagaatgagtatccacatttagatggcacattatgaggactttaatctttccttaaacacaataatgttttcttttttcttttattcacatgatttctaagtatatttttcatgcaggacagttttcaaccttgatgacagggctgtgaaaattttcttcaggggcacctctataatcttaaaaatggggagcatctggctgtttggaaggggatatgacaataaatctatcagatggaaatcctgtacaagtagaaaagccttagtaattacctcaggggtgggtgggttaatcctttttccttttctccctgggc

SEQ ID NO: 16968 - DNA, 453 bp, Homo sapiens
atgaagctaaagctttgtctctgttggcgccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggc

SEQ ID NO: 16969 - DNA, 402 bp, Homo sapiens
taggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattaca

SEQ ID NO: 16970 - DNA, 224 bp, Homo sapiens
  misc_feature 3, 4, 5, 6, 7: n = A,T,C or G
ggnnnnncgggaccacgccgacagtatgcgacggccacacttgcctgaagacctcctcggaaagggaggagttggcctcaacgaagactggtgggaaaaacacagcataatgagtgaaaagggcagaagcaagaaatttctacatcttagcgactccaagaagaatgagtatccacatttagacggcacattaggaggactttaatcttccctaaacacaataa

SEQ ID NO: 16971 - DNA, 472 bp, Homo sapiens
gcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatcaatgct

SEQ ID NO: 16972 - DNA, 210 bp, Homo sapiens
actaaatagaaacaaaacatatagcagagacttgtaaataaaattgaaggcaatcagtaaactgggaaaatacatttgtaattttattgacaaggggtcaacattcttactatttaaagagcccttacagatgaagaaaaagaccccaacacctcagcagaatgcaggctgaagaacatgagccatcagttctcacaggactaaaggtaa

SEQ ID NO: 16973 - DNA, 452 bp, Homo sapiens
gccatacacaatgatttagataatggactgaaagactgcctggaatctaaacccagctttgacacatttactagctagctgtgttattttgggcaggttatttattatttattgtatgtcgtttatgatttttcttcagtaaactcttacctgacctgcttatgcacacctcttatctagattgtaagtttgcctcagtcatagcatgtatcacgttgataaaatcatttgtctgtcttttctgttagactgagcatttcatggtatggctatctttttcttttcatgctgaatgaacgcttttaagtcagtgaatgaatacataaagaatgtgacaagagaaatattcccagtacctggcattatgctgtgagtgtggtaaatgtttaatatgtctgttttaggccggacatggtggctcatgcctgtaatcccaccactttgggagacca

SEQ ID NO: 16974 - DNA, 158 bp, Homo sapiens
aatgcttagaattagaaaaattagccaggcatggtgttacatcgggaggctgaggcaggagaatctgcttgaacctgggaggcgcaggttgcaagtgagccaagatcacgccattgcactctagcctgggcaacaaaagcttaaaaaaaaaaaaaaaa

SEQ ID NO: 16975 - DNA, 539 bp, Homo sapiens
gaacagaagtgggtcactggagttaaatcagcctttgaggtctttctcaccaatagtcctttccaccaacggtactacatttttctcctttccaccaatggtactacagatatgttaaattaaaagtaagggaattagtaatatccctatccactcaattcaataatgaagaaattacagaagtttctgagaaatgaggtgactctaatagtgttacacactgtacacaatcaaaagacaacaggaaattctaagagaaaacatgttgcaagtcaataaggactgtcaaaattgattttccatagaaaaaatacgatgtacacttctgacaagtaaacttaatagcctacattttaaagaaatgacaacctatattaagtcaaaaaatatttattgagcacctttgttagagaccttttaattagacaatgacacacggtactgattaagaaaatcatatctaacatttaatgaatgcctacatgtgccaggtactgtattaagcatttaaatggactgtctcatttaattctcacaac

SEQ ID NO: 16976 - DNA, 360 bp, Homo sapiens
gagagagaaggaatagactaataccaggagatgtggaagtagaaaaacaaaacaaaacaaaaaagactcttggtaccgcaggatatccaatctaggcaaaagacacctaataccagtgatttgacctttttatattagaaaaacaaaaccatattgagatgtgagagacacttgaaaggtataatttgaattttgaacaatgttttccatatggtgcatatgtcatccgtaatcttcacaggtttccaattcactcctcaatgaaattcatgtttctgatttcattccataaagactagaaattgtagccctgaacactttaataatattgtaaaaaaaaaaaaaaaaaaaaaaaaaaaa

SEQ ID NO: 16977 - DNA, 243 bp, Homo sapiens
agaactaaacatgagtacacatgttcacataaatgtctaatgtgaacaatagacaccagggcctactcaagagagggtggtggaaggagggtgaagatcaaaaaactacctattgggtactatgctcactacctgggtgattaaataatttgtacaccaaaccccggtgacacagaatttacccatgtaacaaaactgcacatgtataccttgaaacccaaaaaaaaaaaaaaaaaaaaaaaa

SEQ ID NO: 16978 - DNA, 500 bp, Homo sapiens
atctaaactggagtgatgttaagcagacccagcttagagtttttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaacacttctgctttcacttaagtgtctggccgcaatactgtaggaacaagcatgacttgtactgtgatattttaaatatcacagtactcactttttccaaatgatcctagtaatgcctagaaatatctttctcttacctgtattatcaattttcccagattttatacggaaaaaatggatg

SEQ ID NO: 16979 - DNA, 472 bp, Homo sapiens
agctgacattccttcgacttctctccagccgagcttcccagaacatcacatatcactgcaaaaatagcattgcatacgatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgtctaatcttgcaaccggtgcaagtgaccgacaaaattccagttatttatttccaaaatgttggaaacag

SEQ ID NO: 16980 - DNA, 558 bp, Homo sapiens
atggccgggaacatagggagaccttgactctacaaaaataaaaaaattagccaggcatggtggtgcatgtgcctgtggtcccaagctacttgggtggctgaggtggtaggatcacatgagcctgagaggtcaaggctgcagtgaatcgtgatcatgccgctgcactccagcctggacgacggagtgagaccctgtcaatcagcataaaattctcagtttctaagattttttaatataaaaagcaagtagtaacagatcatctgttatttatgagttgtgatcaatagacccctaaatatctacttatttagtctactgtatcaaatatcatcatcaatgttgcaaaaccaacattagggtattgaataacatcactatcaattaacattttaattggaattttgaggtattaggctttcatttaagtcatctacaaattgatggcaattggacttatcattgctaggtcactgctaatcaaactgttaaactttttctaatagtaaaaacatactgaagatgagaacactggttagaaaaaatatgtaatttttaaaa

SEQ ID NO: 16981 - DNA, 215 bp, Homo sapiens
tcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccgaaaagaaaaaaaaaaaaaaaaaaaaaaaaa

SEQ ID NO: 16982 - DNA, 238 bp, Homo sapiens
agaagaagccataaggaaaatgagaaaatattttgaactgttatgaaaattgacaacgtaacatattccaaatttgtgatacggaactaaagcagtatttagaagggaatgtatagcattaagtatatatattggaaaagtggaaaggtttaaaattaattacctaagctttccccttgaaaaactagaaagagagcagcatagaaggttaaacccaaaggtaaaaattaagagtagt

SEQ ID NO: 16983 - DNA, 385 bp, Homo sapiens
ctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgcttcttttccaaactacacatcactgtatgactcaaccagtagcagttatattgccccttggttttattcagtttaactactgtttccaagataaatgagctaataagctaagaaaa

SEQ ID NO: 16984 - DNA, 528 bp, Homo sapiens
tcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgctgcttgcttttaatattgatatgcttatacacttacactttatgcacaaaatgtagggtataataatgtaacatggacatga

SEQ ID NO: 16985 - DNA, 399 bp, Homo sapiens
ctgaggaagacaagttgaccgtgtcccgtgcacggaaaatacagcgtttcttgtctcagccattccaggttgctgaggtcttcacaggtcatatggggaagctggtacccctgaagggggtgaaaggattccagcagattttggcaggtgaatatgaccatctcccagaacaggccttctatatggtgggacccattgaagaagctgtggcaaaagctgataagctggctgaagagcattcatcgtgaggggtctttctctgtactggctctctccttgcccctaacccaaaaagcttcatttttctgtgtaggctgcacaagagccttgattgaagatatattctttctgaacagtatttaagggttccaataaaatgtcacccctcaaaaaaaaaaa

SEQ ID NO: 16986 - DNA, 510 bp, Homo sapiens
attggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaacccacacacaaagcaaaaactcaagtattaagagcacatattttgacccagtggaggcttaaaaaa

SEQ ID NO: 16987 - DNA, 497 bp, Homo sapiens
gttctgaaagtatgattcaatgtgctacatacaggtaggtcttcagcataagctgaaatatatgcatgtaaaaactttgacatcttttttcttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggcctctggcaagcaagtggtatttggattgcttgctcccttttcccctgggcattgaaatcataaaataacagtaaattccaaacctcaaaaactattatggcctgagc

SEQ ID NO: 16988 - DNA, 428 bp, Homo sapiens
gcttcccaggccccacgtgtgcatgccgggggtgacacccgacatggactacgggaccgagagtcccaatcaaggcattatcatcaatcccatgctttccgatgagaccaatatatgcaatggcaagccagtagatggactgactactttgcgcaatgggacattagttgcattccgaggtcattatttctggatgctaagtccattcagtccaccatctccagctcgcagaattactgaagtttggggtattccttcccccattgatactgtgtttactaggtgcaactgtgaaggaaaaactttcttctttaaggattctcagtactgcgttttaccaatgatataaaagatgcagggaccccaaaccaattttcaaaggatttggaggactaactggcaaatagggcagcgctttcaacagctaa

SEQ ID NO: 16989 - DNA, 679 bp, Homo sapiens
ggccgggagagttgaatgctgaaattaggaaccacaggtggtaatcctgagtagatgtaactcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggcttcgtattctgtaaacccattttttttttgtggccttacagatgtttagaaagggcacaggttactgaattgctacctgccagcattctgatatagcacaaaaagctatttccctttatttttgggataatttttaattttccgggcattgactctagggggggatgagggtttatggccctctgacataagctccatctaaaaactgggcactgtagctgaaattgcttgggtccccaaatgccttggactccaaccccccgcagggcctgaggaggcttcatagagtctaggacttccgtgggcgtgcccccagacctgcccagcaatggcctttcccttttaaggcattaaatccacccaaagccaccc

SEQ ID NO: 16990 - DNA, 396 bp, Homo sapiens
accggaatatacatgtacagagtacattggatcatgttggaaagaaggcaagtgaaaaggcagagatgaagtagccgaagttatggaatatcgcggaaaggatactaggcgggaaatggaaagagacaaggtatagtaccccaaaagcaaaacaagcaggagatgcaagagatgccccaaaaggcaaagcaacaattttctggtgcccctttataccggaagactctgttggagaagaaaagaaggctttggtgcaccttatgggggaggaggaggggcagggcatgctgatgctgagcgacagcagacaagagcgagcccgctgtgcccccatcctatgaaatgactatttacccgaaggacccagggttatgtcccctaatcccttcgcccccc

SEQ ID NO: 16991 - DNA, 270 bp, Homo sapiens
gtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggaca

SEQ ID NO: 16992 - DNA, 504 bp, Homo sapiens
aactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagat

SEQ ID NO: 16993 - DNA, 326 bp, Homo sapiens
ctctatcaaaggcagctcagatagaagaaggagaacgaaggctctatgctcatcgtgataaagtggagcttttaggaaagtaagctttaagctgcttttaccagttgaactccaaaaataatgtaggagagagatggctttctttgtttttgtttcagtggcgggcaaggaagaagaaggggctttttaaattatttaggcgttacggtggtttaactaatcttgagcacttggtagacagaggagaacaaaatgacattaaagttcacctgtcaaattttcatttgtagagggaaggatggtggtctaaatccagcaatcttaaa

SEQ ID NO: 16994 - DNA, 448 bp, Homo sapiens
ttggcgccaacacatggtactcttgatttagcacatctcagctgaggcacctcattgatatttgtttaaaaacaaaaacaaaaaaccttggtgattctgctgtgaagtcctggccagaaacctccagaccgctgatcaacacgcaacagaaccatcaccgttcacctctttgacatggtgccaggataccctggatctctagcttttgctatagttgctctaattagggaataatcttgtctttaatattcctttgctacattttttaacatttcttatctaaatggttttatgaatcagttttacagagaaaaaaaaccagtatttaaaatattcttccaggggctggtccaagtacagtagtgtttacaactatgtgatcacaaccagttacagatttctttgttccttctccatccccactgctttacttgactagccaaaaaaa

SEQ ID NO: 16995 - DNA, 380 bp, Homo sapiens
ctgagataagaccgccggtccgggggcccctcatgtccaatatcagggtgctttagacaggaagacagactccatgatggcacccactgggcccctagacagaaagggaaggacggcggctgccctgggggcactgtgaccacacgcccagaaaagccatggattgctgaagccaccggaggctgggggaggcaggggatggaggctgctttctcagagcctccagaaggaaccaacccagccgacaccttcattttggccccaggcctccagaactgtgagaaaacaaaccctggcgtaagaagcccccaggtgagggtggcttgctgtggcagccctaggcagctatttcatcctaagagagagggaaaggcaagagg

SEQ ID NO: 16996 - DNA, 464 bp, Homo sapiens
gcagaatgcatccctatccaaaatttggtttgaatgttgaaactgatgacaccatacatacacaccaagaaggttaaaggtttactacttatataattaaggttgtctggaagaagaggtcaatcttggaagatcggttagaatctcaaccaatcacttaacctgtgatctgtagaccagcctcattgacataatctcaaaacattttttaaaataaaactttaattttagaatagactagctttagatttacagaaaagttgcaaacatagctcagatacatttttattaactgaagtccatactttactcgtatttccttagtttttacctagtgtcctctttctgtagggcagcttttcagaaatgcaaaatcttaggccccaccacagacttagtgaatctgaattgtattttaataagatcctcaaatgattttaaagacattaaagtttgagaagtgt

SEQ ID NO: 16997 - DNA, 163 bp, Homo sapiens
gacacatgccttgtaatcccagctactctggaggctgaggcacgagaatcgcttgagcctcggagatagaggttgcatgtgagctgacattgcaccactgcactccagcctgggtgaaagagtgagactctatctcaaaaaaaaaaaaaaaaaaaaaaaaaaa

SEQ ID NO: 16998 - DNA, 402 bp, Homo sapiens
ggcagggtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtaggatttatctggttcaaggaagatgcactattcagttatctattgagaaattattttgcagtggttttagtgggtgaaaatgtcccatctgcaccagtacacaggcaggcattatcattcttcacctactttttaaatagtggcaacttggggat

SEQ ID NO: 16999 - DNA, 480 bp, Homo sapiens
gaggtggcagcattcagcattatatttataaacaggatcctgtacagaagtgccctggaagaaggcctggtctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgccttagactgatgagcaaaggaggagtcaactaatgaagaaatgaataataaattttgacac

SEQ ID NO: 17000 - DNA, 199 bp, Homo sapiens
aagtcacgatcaacaaaagttttaagtaaacagactaaaatagaaaagtattagagtatatcaaatgtatttgaaacatttgtttcatccaaaaaatgtgaaaccacacacacacacacacacacacacacacacccctttatatgtatgcctggacatgagcgcaaaatggaactctgctggggcacagcatataaaa

SEQ ID NO: 17001 - DNA, 239 bp, Homo sapiens
gagatcgagaccatcctggctaacacggagaaaccccgtctctactaaaaatacaaaaaattagctgggcgtggtgacgggcgcctgttgtcccagttgctctggaggctgaggcatgagaatcccttggacctaggaggcggaggttgcatgtgagccgagatcaccactgtattagcctgggtgacagagagactccgtctaaaaaaaacaaaaaaaaaaaaaaaaaaaaaaaaaaa

SEQ ID NO: 17002 - DNA, 545 bp, Homo sapiens
ttaccacatgttcaaaggccgcactgaccatttgaccctgctgccccttcactggtagtatagccaaaggctcatataatcatagactaggaccatgcacatgtatgtatattgcagcactattcacagtagcaaagacttggaaccaacccaaatgcccatcagtgatagactggataaagaaaatgtggtgcatatacaccatggaatagtgtgcagccataaaaaaggatgaattcatgtcctttgcagggcatggatgaagctggaaaccatcattctcagcagattaacacaggaacagaaaaccaaacaccacatgttctcacttataaatgggagttgacaatgagaacacatagacacagggaggggaacatcacacactggggcctgtgaagggatggggagctaggggagggatagcattaggagaaatacctaatatagatgatgggttgatgggtgcagcaaaccaccatggcacgtgtatacctatgtaacaaacctacatgttggcacatgtatcccagaccttaattaaa

SEQ ID NO: 17003 - DNA, 309 bp, Homo sapiens
taaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgataaaaaaaaaa

SEQ ID NO: 17004 - DNA, 453 bp, Homo sapiens
tgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccataggatatattttgtttcacaaatttggtattcattcagaataagtatttgaaaagtgagtaaattctatgcaattatagttattaaatgacttataaactgtgtttctcttccacttcttgctacatttaatcttctaggtgtcagatatctttggagattataggcagcaataaagctaaggcagctaacctttcaacattcttgtgtcaggctaatattttgggtgaaaggaattcttgtgtttctcaaaagaactagagctgaagc

SEQ ID NO: 17005 - DNA, 400 bp, Homo sapiens
aaaaaaagaaattattaatccctgcctgtgctctacttagcctcatgggcatcattggatagctcagggggcccttgattctggcaaggcaaataaagccagaatgagaaattaccatcttctactagagaaaaccaagagaaaaatttttatgctaggatgcctttatgaccacttaattttttaatcttagtttaatggcctctccctggggctaactgctgacagtggccacctcttttttgggggtggaggggcctacataactagctggccttaccccatatcttttgttcaaacataataccatctttttgcttcttctgaactttagatctccataacacatgtactgtagaatgtgatggaaaagcattgatgagaatttattggcagtcag

SEQ ID NO: 17006 - DNA, 186 bp, Homo sapiens
ccacctgtggtactagctgcttggaggctaaggtgggagattcacttgagcccaggagttcgagggtgcagtgagccgtgattgtgttggtgaagccccgccttggcgatagagcaaaaataaaataaaatgaaatgaaatgatagagcaaaaatgaaatgaaatgaaatgaaatgaaatgaaatg

SEQ ID NO: 17007 - DNA, 581 bp, Homo sapiens
tggccgggaagcaacaatcaatgaaagcccatctaacactgctcgaaccatttcactgagacagtgtcagattaatacagctgctagcactcttagaaatttttgcttttaaatttttctttttagaaaaaaatgctctttatgacagcctaaaaattttccataactacatattaagaattttaaaaatatgtagtagaggttgtgacttttgggtttcaagaaaagtctcaaagtacagtggtttaaaacagttgttttcagaagaggttattatgaattaactgtctttaactggaaccacacaaagactaatggtgtattttaaataataaatagttataaaacagccaatagtatttacaatatgtagtaatttgcaatttttttccctgtaaacatctttttgtcagagctctcagtaaagaaaaacaaggaagattttagtgcaaaacaccaccttaaaactcaaatttgaaccacaaattatccatcttatgtacaactttaaattttatgtcataaccttaacctcatagctatgtaatatgatttatataaataaaatatcacttcccctt

SEQ ID NO: 17008 - DNA, 570 bp, Homo sapiens
aagagcattgtaatggcatgttttggggagaaaagacatgctcaagtcttgtttactacatttaagatgtttactactatactgggctgctttattaacaatactgtacttgcgtaatatggcattataagtacatgtccttccttagacttttaaaaagttttaatgagagaaagtaaatttactcaacaaaataacatgagaaatcctttacgtaatatctttactggggaattcttatttaagcaaggtcactattttttcctcagacttaaatgaatgaagtgtcatttattttttatttgatgataatcaagaagtgagtagtagtagctaacttaatgacactttgcttaggtttttaaacatgttactattaagactacgtattgtaaaccttctgtaattttcacatatgaatgacaggagaaagttaaacctaatcgaaggagttttggaataaaaaagtgggctggggaaattcaccatggttcacaaagtatgcctttgtaaactgaacaacttttagcaagaattaatttatggagttttaaatgtaaatggggatat

SEQ ID NO: 17009 - DNA, 338 bp, Homo sapiens
actttccttcctagggcagcataagatcatttcagaatgaagatgctttgggatctgcttcggactgtaagaatgacaaactctgaatgggtgcaaaggtagcagatgaccttcaaaggatggtgagattaaatttacctacacctagagaaataattggagcacatgtctatttgggccaagaggataaaggccagtagaggaatcagatcaaagaacttcctcagggaagtgtgcagagaactggagtggaccttcccctaggaagctgcccaaaacgagagtgctggaaagctggccgcagtgaggcacttcagatcccaagggtatgctgggga

SEQ ID NO: 17010 - DNA, 311 bp, Homo sapiens
aaggactgcaaaaccccactctgcatcaactgaacgcttttcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccc

SEQ ID NO: 17011 - DNA, 661 bp, Homo sapiens
gccggggacaattttgaaagcagccagaatgaagcaactcatcatttacataagaccctgaataaaattaatagctgattttctctgagaaaccatggagatcagaaggtagtggaatggcatatttaaatgtctgaaagaaaaaataaaactgccaaccatgaattctatgtatagcaaagttgccttcaagaatgaaggaaaaagtaacacattttcagataaccaataattaagggattttattaccagtagcatgtgctacagaaaatgctaaaggaaaccttttaggctgaactgaaagtcactagacagcaattcagagcctccaaaataaagaatattcataaaagtacaatagaggtaaatataaaacccagaattactacatgtgtcatatagtttataactctcctattatagccttctatatttatatttatctatacctcataggccaatgaataaaaattataaatatgatagtgggcatataatgtataaagatgccatccgtgacagccttatgaagcagggatgaagcatataggatcaaatgttgcatagttattgaagccatgtggtattatgaaattatattgttccaaggttaagaaggcaattataattcccaagggacccctattaaaattcccaaaat

SEQ ID NO: 17012 - DNA, 415 bp, Homo sapiens
cccaatatatgtgagcacattttccacatccccaaatatttttgtaaaaatatttcttttaaatatctgcatagttttgtacccattataatttggctctggaagaagttcaagatatgccaaatagtcttggcacaatggctcacacctgtaattctgacacttttgggggccgaggtaggaggatcacttgaggccaggagttcgagaccagcttggtcaacctagcaagagctatttccacaaaaagtgaaaaaactacccgggcgtggtaacactcccatagtcctagctacttaggaggctgaggtcaaaggattgcttgagcccaggagtttgaggctgcagtgagctatggtcgcaccactgcactccagcctgggtgacagagcaagaccttgctccaaaaaaaaaa

SEQ ID NO: 17013 - DNA, 522 bp, Homo sapiens
ttctgtaagaaacatagggggaaagtttcttgatattgatcttggcaatgatatttttggatatcacaccaaaagctcaggcaacaacaagaaggataaatacatgagactacatcagactacatcaaactgaaaaccttctgcacgttgactgggtgtggtagttcacatctgtaatcccagcactttgggagaccaaggttggaggatcacttgaggccaggagatcaaggatcaccctgggcaacataatgagatctgtctctataaaataaataaataataaaaaattaagtgaaataatcaacaaaatgaaaagacagcctacagattgggagaatatacatgtgtaaattgggactgtcctggcagactgagataaatgattgccttacctttttctgaaaaaattactacctgcccttgggactgtgtttttgtcttacctaagaatttgcccatgggtacaacagcatgctgacacaaagcaagaagcttgtatagttctgatcttaaagtgga

SEQ ID NO: 17014 - DNA, 428 bp, Homo sapiens
cagatgcacatccctggaaggacatccatgttccgataagaacagataatccctgtatttcaagaccgctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttaagaggctggtttttctcttttcctt

SEQ ID NO: 17015 - DNA, 569 bp, Homo sapiens
gaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtg

SEQ ID NO: 17016 - DNA, 227 bp, Homo sapiens
ccaagccggacagtcacatcccagagaattcgggcggacgtggaccacgcgcgccaacctgggcacctgctaaagcccagcgagaagcacaggagaaaaagcaaacactgtgggcctcaagcatgcgaagctcttcatctatgccttcaggacgcatctgcgagccctgtgagttgcccacctggatattggcctgggacccgatgggcgggacgcgcaggagagac

SEQ ID NO: 17017 - DNA, 471 bp, Homo sapiens
ttcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaaggtaaagggtttgtcattgtttctttaaaaaaaaatacaataatgcaccatatccctatgcataaagtgcttcttctatttataaggttgaaaattctgaataacccttttagcttgaaaaaaaaaccaaacccaaaaaaaaaaaaaaaaaaaaaaaaaaaaaa

SEQ ID NO: 17018 - DNA, 502 bp, Homo sapiens
cagaatgcatccctatccaaaatttggtttgaatgttgaaactgatgacaccatacatacacaccaagaaggttaaaggtttactacttatataattaaggttgtctggaagaagaggtcaatcttggaagatcggttagaatctcaaccaatcacttaacctgtgatctgtagaccagcctcattgacataatctcaaaacattttttaaaataaaactttaattttagaatagactagctttagatttacagaaaagttgcaaacatagctcagatacatttttattaactgaagtccatactttactcgtatttccttagtttttacctaggtcctctttctgtagggcagcttttcagaaatgcaaaatcttaggccccaccacagacttagtgaatctgaattgtattttaataagatcctcaaatgattttaaagacattaaagtttgagaagtgtggttaacaaaagaaaaattttcggaaggagcattggggga

SEQ ID NO: 17019 - DNA, 539 bp, Homo sapiens
gagaaggacgtgccgtgccgctgggttctgagccttagtggtcggtgggtgggatggaggcgaccggggagcagcacttggaagacacaatgaagaatccctccattgttggagtcctgtgcacagattcacaaggacttaatctgggttgccgcgggaccctgtcagatgaccatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgcataggaactggatcctacctatgttaattaccttatagaactactaaagttccagtagttaaggccattcatttaatgtgcattaggcacttttctggttatttaagaagtcaattgctttctaatgctctatggccgactatcaagatattagtaagaaaggatcatgtttgaacagcagg

SEQ ID NO: 17020 - DNA, 510 bp, Homo sapiens
caggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgtaacctgcaacatttcgttgggttttgagcagaatgaggttcagcttgggactttggaatgtaataattagta

SEQ ID NO: 17021 - DNA, 505 bp, Homo sapiens
ggctgatagtggaatacctggaaattctttcaatgtgtcatccctggttgagctggatctgtcctatacaagcttaaaaacataccaactgtcaatgaaaaccttgaaaactattacctggagggcaatcaacttgagaaggttgacataaagagcctctgcaagatcctggggccattatctactccaagacaagcctttgcggttggatggcaaatcgcatctcagaaccagctcccccggatatgtttgaatgctccgtgtggctaacgaagccccctaaataaataccgggacccgggaacaatattaaggggtatgttttctgtgggtcagtttcatagtatccatattttattactgttattacttccatgaatttaaaactgagggaaatgtttggaaacattattttttttaaagaaaagatgaaaggcggcctattcatcacaggaccccccctttccccaatggcctcaacccaatgcttattggaaattagggg

SEQ ID NO: 17022 - DNA, 473 bp, Homo sapiens
atcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaggattttcttcttatttaatgtgggttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgt

SEQ ID NO: 17023 - DNA, 275 bp, Homo sapiens
aatattttgaaaattttctcagttaaatttcctcaccttcactattgatctataatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaat

SEQ ID NO: 17024 - DNA, 289 bp, Homo sapiens
gccgggatacattacttagagtagccgacagaagcagtgtcatcttgaggaaagcggggtgttggcagaatcctggggggaggcaggaggccaagctgagttgtggctttaccacctgagggcgacagggccacaagtatattgcacttctgccccaagcttcttacagacacttaaggagagacaattaatgtgggaagggagggtataaacatgtcataaacctcaggatcaaaggagtcttaaaagtgactaaaagcagataagcagatgcttaaaaaaaaaaaaa

SEQ ID NO: 17025 - DNA, 248 bp, Homo sapiens
gcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagccaaaaaaaaaaaaaaaaaa

SEQ ID NO: 17026 - DNA, 490 bp, Homo sapiens
tatctgcgtttatctcacaacgaactggccgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtggtcagttttcatagtatccatattttattactgtttattacttccatgaattttaaaatctgagggaaatgttttgtaaacatttatttttttaaagaaaagatgaaaggcaggcctattcatca

SEQ ID NO: 17027 - DNA, 474 bp, Homo sapiens
acactttcactcattctaatgggtaaagtgttgaactgcaataaacaactgtatatgtacaaacaggtcgataaggcattagtctatcaaactaacaataaaataaaacttacggggtctgcaaggaaaactatgaaggccactcaaagtggttcaggtatccctttgtcttgtagggcatagctgttggtttagccaggcttttacagtatctaattttaaagtatcctataactatcaacttcccaggttgaagacgatgtgctgagttccctactgattgattgattcctgtcctccccagtgtttccgcactggtcactaaaacagtatttatataagctgcactggctctaaagctctcgtccttctaatattttggatccacaaggaaaaatggaaaaaaaatagaaaagagacaatcaaatgcctggagcttaaaacaaagaatgggcacctaccacctactggaag

SEQ ID NO: 17028 - DNA, 571 bp, Homo sapiens
agaagaaatcaaaaaagaaattagaaaatacctcaagagaaatgaaaacaaaaacacaacataccaaaacttataggattcagcaaaacctgtactcagagagttcgttgtgataaatgcctacattaaaatagaagaaggatctcaaataagcaacctaactttatacctcaaagacctagaaaaagagattaaggccaaggttaacagaaggaaagatataaggattacagaagaaataaacaatacaaaaacaataggaaaaaaaatcaatgaaactaagagttggttttttgaaaagattttttaaattgcaaatcattagctatgctagaaaaaaagagaggagactcaaataaataaaattataaattaaagaagagacatcacagctgatgccacagaaataaaaaggataagaggctactatgaacaattctatgccacaagctggataacttaaaagaaatggatatgttcccagaaaaatacgagactaaattatgaagaaatataaagtctaaacagacctataactaatatgaagattgagtcagtaatcaaaaactcc

SEQ ID NO: 17029 - DNA, 507 bp, Homo sapiens
gcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatcctcaatatcaattgtgggcacacttgaagctgaaaaa

SEQ ID NO: 17030 - DNA, 525 bp, Homo sapiens
aagccgattatgaagggcccacatgctaggggtcaggaccggcatcgagagccttcctgaactgacccatgcctgcggagggaaagaccatgtatttagctccatggtagaaagtgagctacatgctgcaaaaacgaaacaggcatggaatttcttatctcacttgccagtgataaatgttggcataagtgttaaaggctcgtgggatgacttagctgaaggacataatgaactctctgtctcaactctgactgcagacaaacgagatgacaacaaatggatcaaattgcatgctgccaagagtatgtgcttcaagtgagcttgcagagagccactttgggttccacaagggaaagccagagagctgtgcagttactcctcgatttcccaaatcaaaagacgaaggatggtttttgatattaaggagaaggggataagagagaacttattgctttgaaaagagtagggatatattcgaaatcatcatgtgcttccccttcttttataccctgaaatacctggagg

SEQ ID NO: 17031 - DNA, 577 bp, Homo sapiens
tggccgggacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttacctgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcgaccactgaactgccttcttccattgcctgcaatgatataagggtacatttttgtgtatatggctttcatagttgggatttcagagcactgatccagatatttcagttggtctctgggggaattcatttgcatctatgtttagctatctgtgatacctggtaaatattaaaaagatattttgctctattggacatttgatactcgcactatttttc

SEQ ID NO: 17032 - DNA, 470 bp, Homo sapiens
aagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatt

SEQ ID NO: 17033 - DNA, 269 bp, Homo sapiens
ccttttaactttctttttgttatttgcttttctcctccacctgtgtggtatattttttaagcagaattttattttttaaaataaaaggtctttacaagatgataccttaattacactcccgcaacacagccattattttattgtctagctccagttatctgtattttatgtaatgtaattgacaggatggctgctgcagaatgctggttgacacagggattattatactgctattttccctgaattttttcctttgaattccaactgtg

SEQ ID NO: 17034 - DNA, 660 bp, Homo sapiens
taatcaaactactcatttttcccatgatcacatgggctactgcagcacctacatttctcctatcccctcatttggccttgaattagagctccttgatccactcatgcaaggtggtccataaaacacatcaaataaaccatgtcgaataagcttctgatatcaaaatatttatcaaaaaagaaaacattgaatgaccacaaaacagaataaatctttaacctcggcactggtgaccagcaatataaaactgcaacatttgaagcactggcaatgatgactcctttaacactagtttaactcagtggccattgttgttaaactgttcataatttctattcctcagtaatatgacccaatacttcatgttaccttgtgtattatgagtaaggttatataaataaaacagcaagataattctgaaaatttcttgcctcaattccaagggtaaagacagctatgagttactagagatactaagaaattactagaataactaatagttactaggagatagtaggaatatcttaggttcataactgggtaagatggtttaaaaattacatataaaattatgatctattgggtcctaaagggataggctgaaagggcatgtcatttggactatgccttggtagtaaagccaaaaaaaaaaaaaaaaaa

SEQ ID NO: 17035 - DNA, 451 bp, Homo sapiens
ctgaacaacagccttcagtcctaggccttccctctgtctgagcctacccaaatgacaaggaaccagaaaaccaaccttggtaatatgataaaacaaggctcttcagcaccccccaaaaatcacacaagcaatagatccaaaccaagaagaaatccctgatttcccgaaaaagaatttaggaggttagttatttagctaataagggaaagatcagagaaaggtgaagcacaatgcaagaaaatccaaaaaatgatataagaagtgaagggagaaatattcatggaaatagacagcttaaagaaaaaaacaatgaaaaattcaggaaactttggcacacttctagaaatgcaaaatgctctggaaagtctcagcaatagaattgaacaaccagaagaaagaaattcagagctccaagacaaggtatttgaattaacctaattcaacaaagacc

SEQ ID NO: 17036 - DNA, 259 bp, Homo sapiens
catggaagcaacaaaaaaacaaagcacatgctgtccagaggcttccggacgtgtcctggaccacatggggcaaggagctggaagagccgcgcgatgcgcaacaaatcctacggagccgcgaacgctcacaatgcgcccccaagaaccgcaaagccatcttagggaagagctgcccagctggccatcaggagtcaccaaccccaatgccaggctgcgcagcgaagaaaatgagcacggcagctcatgtgcacgagctctg

SEQ ID NO: 17037 - DNA, 489 bp, Homo sapiens
taaataaatgaaccagatctatatgtatcaatgtgaattattaaaataatgttgtacccagacatcatggctcatgcctataatcccagcactttgggaggcagaggccttcggatcatatgaggccaggagttcaagaccagcctggtccacatggtaaaaccccatctctacgtaaaatacaaacattagccaggtgtggtagtgcaccgtctataatcccagctacttgggggttgaggcatgagaatcacttgaacccaggaggtggaggttgcagtgagctgagatcacacctctgtactccagtctaggcaacagactgagactctgcctcaggaaaagaaaaaagaaaaaaaaaatgggctggcctagtggctcagacctgtaatcccagcactttgggaggccaagggggggggatcacttgaggtcaggagttcgagaccagcctggccacatggcttaaccctgctctactaaacttcc

SEQ ID NO: 17038 - DNA, 450 bp, Homo sapiens
tccttttctcctcctgtgttctagagacgacccctttctgactaaagccaagggtttttttgagttttaaatctctaaaatcgataagctttttttaaattttgattttaatttaatactgacaaatatcttaaaataattgtatatatttatgggatacaacatgatgttttaccacacataaaaattgtggaatgagcaaaccagttctaattaacatatgcatcatctcacctacttatcatcacttgggggggagaacatgtaaaatccacccttctagcaatttggaaatatacaatacatgattattaactatatggacctagctgggctaaagatcaccagaacttatttctcctaactgaaattttggacccttttgcaaacatttcccctttccctgctcacaccaccccactttcccagcctctgggaatcaccatctac

SEQ ID NO: 17039 - DNA, 548 bp, Homo sapiens
ggttcaacttagaatttttcgactttgtaatggtatgaaagctgtgtgcattcaatagaaagcatacttcaagtacccatacaaccattctgtttttcactttcagtatagtattcaataaattacatgagatagtcaatacttgattataaaataggctttgtgttatctattttgccgaagtttagactgatgtcagtgttctgtgagcacatttaaggttggctaggctaagccatgacgttcactaggttagctatattaaatgcatgttcaacttatgacatgttcagcttacaatgggtttaatctggacatagtcccatcatacatcgaggagaatctgaccatgaactcctccatggcgaggagaaactagtcacagaaactaatcccaaaatatggtacagtgcctagtacatattataatttgtgtattttccaaatcaaactaaaaacctaagcttcctaggggaagaagggtcgatgcagaaggagcccacagacctatggaacctgtaatgagggggtggggcatgggggtttga

SEQ ID NO: 17040 - DNA, 483 bp, Homo sapiens
atgtggaaaaggcattagaaccctttccggttttatcaccatttatatagtcgagacagttgttggagaagaaagttatcctacctcgccaagtggtatgaaattaagtgaccaaatgaagtgcactcttttcttttggaattagattcatgactttctgtataaaattcaaatgcagaatgcctcaatctttgggagagcttcagtactggcatagaatttaaatgtcaaaattctctctgaaaccctttctcctagaaactaggaaataataggtgtagaagactctccctaagggtagccaggaagaagtctcctgatccggacaaccatgaggggtagtggtgctagggagaaggcaaccttcactggttttgaactcagtgcctaagaaagtctctgaaatgtccggttttaggcaatataggatggcttaggccctaatcaccattcttttttaagatctgatatgctatcattgcc

SEQ ID NO: 17041 - DNA, 523 bp, Homo sapiens
aatattcactgacagtctgaaagatactaacatactcaccatttatttctccttgccatcacttttatgctcagttttgggggtctccattttgttttctcttcaaccatgaattcatattgtttagaaagtttctttgaattctgagagagaatgagaaattagaagagaaaatcaagtgagaaccccatgccttatttaattgaagagtttctcccccttcacctcctaaagaggaatagtagagagtttccacccatatgtaaagaagtggtgtcagtggaatatcatggtacaggagcaatattttgaaatgtcttgttgctggttaaatacagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggc

SEQ ID NO: 17042 - DNA, 207 bp, Homo sapiens
gacctatcctgatgtataatacagcaggtataattacaccaagcgctatagatataaatatggcatgaagtgaactatggccttttatttccttccggtgtgaacacagcaggtgtgagatgtcatcttggaagacaggccttgcagaaataggcctacatccaaaatattatcttgtgactccatgaaccattcattaaccctttg

SEQ ID NO: 17043 - DNA, 640 bp, Homo sapiens
ggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaaccacagcatcctacaaggaagaaatcgtgcatcagctgcccagtaataaaccagaagagctagaaaataatgtagatcagatcttgaaatggattgagcaggggatcaaagatcatactcttgacttataaggctactacttaataatcactcttggtggatatctctgccgacatcatagaaattggtcaagtgcagtacccctttattaaaacatgttgcagaacccgcaggggggta

SEQ ID NO: 17044 - DNA, 347 bp, Homo sapiens
gacaaatgagggaacatctgggttatgccttttttaaagtagttttctttaggaactgtcagcatgttgtgggtgaagtgtggagttgtaactctgcgtggactatggacagtcaacaatatgtacttaaaagttgcactattgcaaaacgggtgtattatccaggtactcgtacactatttttttgtactgctggcctgtaccagaaacattttcttttattgttacttgctttttaaactttgtttagccacttaaaatctgcttatggcacaatttgcctcaaaatccattccaagttgtatatttgttttccaataaaaaaattacaatttacccacaaaaaa

SEQ ID NO: 17045 - DNA, 610 bp, Homo sapiens
cgacatctacaagatccgggagatcgcggacgggttgttcctggaggtggaggggaagatggtcaagtaggacagaaggtaacatttgatgactcgctcattggtggaaatgcctccgctgaaggccccgagggcgattgtcccgtaagcacagtaatcactggtgtcgatatggcatgaaccatccctgcaggaaacaaaggttcacaaaagaagccctccagaagtacatcaaagattcatgaaatcaatcaaagggaaacctggaagaacagagaccagaaagagtaaaaccttttattgacaggggctgcagaacaaatcaagcacatccttgctaatttcaaaaactaccagttcttttattggggaaaacatgaatccagatggcatggggtgccctattggctacccgggagggatggggggacccatatatgattttctttaaaggggggttaaaaatgggaaaaaggttacacaagtgggaataatttggggctatcacccggcatcataactgggttttgcttggcatcccccaacaccaggacttaagacaaatgggccggatggcatcttgagcccttcaattaattttgaccgggat

SEQ ID NO: 17046 - DNA, 512 bp, Homo sapiens
aacattaccttgctttttttctttcctggatgaaagtaaaccttgtcctagaagggcaaataatattttcatcctttgattccagctccattcagtgcatcgagtgtgctttagtgttatccctcatctatttgtttccttgggtggagctagactgatactgtggactgatttaaatgtaggcagtctggcatttgggagaaacctagggttcctcactcaagaatcattttgtggttgggttattaagacccctctatctccaggcactttctctaagagttatatgaattgctccctctaaactggggtgagagttctaaacacttgaggaaccatgctttgatattatacctgttgatttttgtgccttttaaattagtactttcaatagtaaagaccaggtgttacttgtgcaaggttttgggttcctatagaaacttaaagtttagaaatagacactattccatggaattgtgacaatcaccattaaatttccagaaatgtctaaa

SEQ ID NO: 17047 - DNA, 506 bp, Homo sapiens
aacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaaca

SEQ ID NO: 17048 - DNA, 274 bp, Homo sapiens
ccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaaccttccagccaggatcctggatgccacgagatggcaagagccacaatcaatgaatgcattatggtcaaatcttttcatgtatatggatgtgactattttaacaataaaaaaaaaaaaaaaaa

SEQ ID NO: 17049 - DNA, 363 bp, Homo sapiens
acactccttggaaacatttgaggaaaaaaacgttatttgcacctcactttgcggggatatcccgtagcactcaacaaactcagctgctagagtgccgatgtcacggagggctgggtcagggcaatgccgtgtggctgaacagggcataaccactgtggcttctcgtgctgcagaagctcggcgacaagactgaggaggatttcaagagcaaccaagcaaagtcatgcatttccgaagtccgtgtatacggaatatatttttaaatagagagctctctacgcgagataatgtggtaagattgctacacctaggctaagcactattgactgtgctagtaagaaaaagaaaggaaaccatcattgc

SEQ ID NO: 17050 - DNA, 580 bp, Homo sapiens
tcggccattatggccgggaggaaataaaaccccatctgtctattgtattcttataagtcatatatcactgctactgctgttaagaaaccaggaaataaaattttggcaaaagttatttcggcaaaattaccataaaaaatgtacatagtatatgtaagtgaaagtttttaggttcctattggacacagaattataaaacaaaggaaaaagctactgagctctttgcaagaatagataatcaaataactgtattttagggcagaatttttaatgaaatacaggtttcagtcatatttttagttagaatgaatatgcatatgctagataccaaaatagtattaactaatctttttaagattcatgtaattctaaatcttagaaagtagttttgtataaaatatttccttgatttgactaatttttttggtattttctcactcaaaaaaagcagtaacattttccatttttatagttatcctttgtaaaagcacagataaagagtttattcaaaattattttaaaatgttttctgcgctaagaaattattgacaaaacaggcctaacttttttatattataac

SEQ ID NO: 17051 - DNA, 282 bp, Homo sapiens
ataagcgattctaaaccgctgctgggtacttacacaaatgggtaaagccatctacataatatagaaagatatgcatatatctagaaggtatgtggcattcacttgggtaaaactctcaattcagagaaatcatctgacggcctataggcctccccagctcaaaagaaaacaataccctatgtagttgtggaagcttatgctaatattgcggaactgatattaaacctaaatgttctgcctaccctggtggaataaagatattttgagcagactgtaaacaag

SEQ ID NO: 17052 - DNA, 514 bp, Homo sapiens
aagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggtatattagtgcctcaggaatgtgtcactactggtcaagcaatactcagaaat

SEQ ID NO: 17053 - DNA, 511 bp, Homo sapiens
ttttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgccaactaatcttgatattaaatcattcatcacaagtattgcaaacaagatggagcttgctctgttgccagactggagtgcagtgcacaatctcggctcactgaaacctcctcctccgggtcaagccatctcctgcctcagcctcctgagtagctgagactacaggcgtgtgccaccatgccccggctaatttttatatttat

SEQ ID NO: 17054 - DNA, 405 bp, Homo sapiens
gccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatggttttaaacttgacaatcattacactaaaacagatttgataatcttattcacagttgttattgtttacagaccatttaattaatatttcctctgtttattcctcctctccctcccattgcatggtcacacctgtaaaagaaaaaagaatcaaattgaatatatcttttaagaattcc

SEQ ID NO: 17055 - DNA, 223 bp, Homo sapiens
tctgaacttctgaatatttgtttttctccttattgaagggatgtgacagatgatgaatcctttgttgatgaactgagaataacattacgtttttttgcatctgtcttaataagaaggattcacaaggtatatatttttaatgagaaatttgggaatttggggctttatcatttaatgaaagagatttaaaacaattttttggaaaaaagaaagtagcttaagt

SEQ ID NO: 17056 - DNA, 246 bp, Homo sapiens
tgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattttaaaaaaaaaaaaaaaaaa

SEQ ID NO: 17057 - DNA, 573 bp, Homo sapiens
cagatttgataatcttattcacagttgttattgtttacagaccatttaattaatatttcctctgtttattcctcctctccctcccattgcatggctcacacctgtaaaagaaaaaagaatcaaattgaatataccttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagttacagatggtaaatatcacctgctca

SEQ ID NO: 17058 - DNA, 589 bp, Homo sapiens
gcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgcattttcagaatcatcttttgaagcttctgtgatgtaactgagctactagagatatcttatttcactaaatgtaaaatttggagtaaatatatatgtcaatatttagtaaagcttttctttttaatttccaggaaaaaataaaaggaggatgagcctctggaatcatggagcggtagctcatttgagaataaag

SEQ ID NO: 17059 - DNA, 560 bp, Homo sapiens
gatgaagacttttatgatattgatgatgacacattttttgataggactggcctgattgagaagaagcggctgaacagaatgaagaaggctggcaagattgacgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttccccccaagcgccagaactccctccaactctaatgagaatgaaagatgagcctgaag

SEQ ID NO: 17060 - DNA, 599 bp, Homo sapiens
tcggccttatggccggggggaagtagagtgtctaatcctgcagtcatggcgcaggaagaggaagatgttagagattacaatttgactgaagaacagaaggcgatcaaggccaagtatccgccagtcaataggaagtacgagtgtgaatttggatcatacagcagatgtccagttacacgcatggggagatactctggaggaagcattcgagcaatgtgcaatggccatgtttggttacatgacagatactgggacagtggagcccctccaaacagtagaagtagaaacccatggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgccaagcaccctcagggaacagaagtcaaaagcaataacatattcagcaatgcaggtctataatgaagagaacccggaggttttgtgatcattgacatttaagacaccaaaaaataaaagactcctatgaaggaaaaaaaaaaaaaaaa

SEQ ID NO: 17061 - DNA, 416 bp, Homo sapiens
tcttaaacatgattgtaaaacataattcagaaaaaaaactctgattaattatattgcactgtattcaagtaaaacgtattacgtaaaatatgtatttgttaaaacttcctaggtctattctaaatgctgtgatgtttaaatatttaagaatttcttggagtttgtgattctttatttcaattccagtactttatgctctctttttctttttcactacacagcactttctcattctatatcattttgttaaaaggtgtatatattttttgtcctgaaaacataatatttcatgtagacccaatatagtcatgtagacctgatatatgaaataacatttattcattcaacacatatttattgaacacctggtctgttctagtactggagatactgccataaacaagcagaaccattct

SEQ ID NO: 17062 - DNA, 371 bp, Homo sapiens
gatccggactctgggtgttttgctaccgtgaccgtttagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagttatgatctga

SEQ ID NO: 17063 - DNA, 315 bp, Homo sapiens
ctcattcaattgatgggagagtagttgagccaaaacgtgctgtagcatgagaggaatctggaaaaccaggggctcatgtaactgtgaagaagctgtttgttggcggaattaaagaagatactgaggaacatcaccttagagattcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaacc

SEQ ID NO: 17064 - DNA, 561 bp, Homo sapiens
agattgaactttccccgtctcccgtcttctgtctcccactccataccccgccaaggaaaggcttgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccactttcttatccaactttttcataagtaagtgcgaagactgaccagattggccaattaaaaacgaaacctgactaggtctgagagccaatagacttgaaatacgttgtgttctagaacacagctcaagcatctgttatcactcctctccttgtacagcctatttggtggggcttggca

SEQ ID NO: 17065 - DNA, 540 bp, Homo sapiens
tctttctttttacaggaactattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgtctcaatgaagagcaaatttaaatattatgtgcatttgtaaatacagtagctataaaattttccatacttctaatggcagaataggaggaggccatattaaataatactgatgaaagggcaggcactgcattgtaaataggatttctaggctcggaggcagaaagaattattttctttgaaggaaataaccttttatcatggaattttgaaggatgatcctatgatgggtca

SEQ ID NO: 17066 - DNA, 280 bp, Homo sapiens
acaactacattttcattcgatgttaaatatgcaacttggaccttggatatcatgctacaaagtccaacctgttggataacttgttatagaaaacaataaaaaaccttaaactatcataaaatattactgatgttaacagtcatgtatgtataacacatcactgtatctagattttcctgttattggatgtttaaattaccaatgtacaatcaggttttaaaatgtaatacttaaatttccattcactatgtaaaattaaaagctcaaaaaaaaaaaaaaa

SEQ ID NO: 17067 - DNA, 491 bp, Homo sapiens
aaacacatatgagctctgcagaacttcacagcttgatttgctgttggctagtctgcaatatatattatatatgatgtgttggactccattttctttgagggtttttattgtttacaaacttattttttattcagaacaagatagctaaataacctctgaccaaagtactggggttacaggtgtgagccaccgcaccccgcctgaaatagttcttaaattcaaattcaattttgtgtattccaacagtattatctcagcagtttagttttttccagttcacatccatccatctgcctgaggagaccaatgctgtcagctttccttattctcacaggtgtccatctaatcaagaatagttcccaccaggcttctgattggcccaggttaggtcacatgcatatcctcaaatgcatcgccataacaacagggatggaatcctttcagcacttgcttggccttatgtctactgctgtaggtaggtaggttggttg

SEQ ID NO: 17068 - DNA, 259 bp, Homo sapiens
tgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaagtcccttttcgacatcacattcctgtgttttccctcagcctggaaaacatattaatcccagtgcttttacgcccgggaaaaaaaaaaaaaaaaaaaaaaaa

SEQ ID NO: 17069 - DNA, 319 bp, Homo sapiens
gatatcattttactcttctttctcttctatatttcttaaattctggttcttttcctgtacgtgtgttttagcggggccctttgctttgaacttccgcctaattagcctgtacatttttgtttcttttaaggtagaacagatctttctttgtctctcctttcaagtctactggttttaaaagaggtaaatgtatccatagaccacagtgccttgctttttcctctgccagcacatggagcacgggattagatgcacaaacctatttagggaactattttggaagatgtttgagttgatacagaaattgcagctggcattt

SEQ ID NO: 17070 - DNA, 463 bp, Homo sapiens
gttaacaggtggtaatgatatgacaaatgagcatatgaagaggataagcaccaggtgttgtgcgatctccttggaggcatatccacctagccttggaaggagaggtgacaggaagggaagtttccctgataagaataatgaagtgttagctacaccggtataagggtgaggatggggatatgtgttcaattgcggggggaaaaaaaccttctagtttaaagacctggacactggagaagcctaggcttatcgaggaacagaggaggtggtgtcaaggaacaatttataatttagaggctgggaatggtaggggagagtgggaaataaagagtggttgattaatggggacaagtatatacttggaagaaataagacttggtgtcaatagatcagtaggatgactatagctaacatcaaccaattgtacatttcaaaatagctggaagaaaataatcaaatgtct

SEQ ID NO: 17071 - DNA, 650 bp, Homo sapiens
ggccggggactgctaggggcttaagcggagggagtcgagccagccgtcgccgtgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatcatttcctgctttcaccaattaaccactgaattgctattttttccttttggccagatagctaggttctggtcccccacagtaggggtatcacataagatagggtccttttggaaagaatagttgagtgtttataggatagtgggggaagaactagtttatttgcattggctaattggc

SEQ ID NO: 17072 - DNA, 399 bp, Homo sapiens
aggagacgtcgctttgaacgtgctataggaccttcttaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaa

SEQ ID NO: 17073 - DNA, 368 bp, Homo sapiens
gaaaactaacaatagaaatattattttactgcattgaaataccatgaactttcagacttgttagttctacaagcagttgtgctaccttaattttgtgtttccagaaataaaaattaaccttagttatgctgtcatttttaactaataaaaaaagtataattcataaaacttttggctttataagataattataaaattatatatttttttctgtttttgggggggtgggaaaacattttcttatttctattcactcttcaaatgcaggtctcataatatgtgtcaatgatataagatgatggaagactttgtaataaaaacatatgtcattatcttcaattggtcaataaataatttaatgtgaatcg

SEQ ID NO: 17074 - DNA, 122 bp, Homo sapiens
  misc_feature 2: n = A,T,C or G
gnagcagctgggactacaggcgcctgccaccacacccggctaattttttttttttgtagaggcggggtttcactgtgttagccaggatggcctggatctcctgacctcgggatccgcccacc

SEQ ID NO: 17075 - DNA, 257 bp, Homo sapiens
tgaggccaggaggtagaagttgcagtgagctgagattgccccactgcactccagcctgggggacagagtgagaccctgtctcaaaaattaaaatactacttaggctacattgtgggggggtggtaagtctatggattttgatttcctttttgctgttttctatttttggtaacttgtttatgtaacttcattttttaaaaaattgctacattcaaaatttcccccaaaaaagaaacttcatatacaagttagttcat

SEQ ID NO: 17076 - DNA, 522 bp, Homo sapiens
taagaaaattaagtcaaagtatgaggtgaaatatgccaaatgtcaatgaagtgtcccttgccactggaggctgaggttaggagtctcatgaaagttgagctgctacataattacatgtataatacacatattgaattggtgccaaggtaaagagatgacccaccaattcagtccctcacaagtgaaacatcagcttggctgagacattacacgctgcaaggaaataaattactcactctttggcagggcattttgtgccacagagaaataattttctaaagggcaccttggtagtatgaaaggaggatttaagaagtttccagagagagccataaacccttgaagatccccagccccatagccagctgactgtgtctgtgtgacaactgaaaacaggagctgtttaaagatttggacacaggctactaaggatgctcagaggtcatctagactaatttggtcaaaaatcagtggtacctagagtgtgtggccacttctctcaaatatctgctgtactaggtc

SEQ ID NO: 17077 - DNA, 313 bp, Homo sapiens
aaagacatgatatcagaagcagaaaataaagtgatccgtttgactaaatagaaacaaaacatatagcagagacttgtaaataaaattgaaggcaatcagtaaactgggaaaatacatttgtaattttattgacaaggggtcaacattcttactatttaaagagcccttacagatgaagaaaaagaccccaacacctcagtagaatgcaggctgaagaacatgagccagcagttctcacaggactaaatataaactacatatatatagatattcttttgatttaataatcctacatgtagccatttgttctaat

SEQ ID NO: 17078 - DNA, 178 bp, Homo sapiens
acaagagggactaacggcttgaaggccaaggtgggagaatcacttgagcccaggagttcgagggtgcagcgagccgtgactgagatggagaagcccccttgacatagagcaaaaataaaataaaatgaaatgaaatgatagagcaaaaatgaaatgaaatgaaatgaaatgaaatgac

SEQ ID NO: 17079 - DNA, 142 bp, Homo sapiens
tgtgacacccaagagaggtgccaccacgcacaccctcccgcactcacacgcgagggaaccattacctctcacagacaaagaggcctgggatatgaggactcggggggggtgaaagcatcatggggcagacagatggggatgg

SEQ ID NO: 17080 - DNA, 600 bp, Homo sapiens
acaggttcgctatggtcagaagatgatcttacatcatttgttggagctgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagatgttttgttctcagttttaaccaaagccagtggacatacggtagtaataagtaagtcttgttgtgtttcagcatttaataatagactttggaggtagacccctggtttaaatctaagctagtttgaggaagcacttaacctttattgaaaagactctggatttaataagctgggaactgggactcgataggtacccaaagtcagctagatgcacaacccctctcagggaataaaccctaagacatcctcaaggaggactcaattattaaatttggaacggtttggcccctctggccataaacctgacagca

SEQ ID NO: 17081 - DNA, 116 bp, Homo sapiens
aaccagaaggtctgcctccatacagaggggggttattaaaggtgaacaagggccagcacgagaagacaaagaaagacaaggggcaggcccaagctgggtccgggatatcccaggag

SEQ ID NO: 17082 - DNA, 195 bp, Homo sapiens
tgaaggcccttttacacaccggacctgaactttgggacactaaaaattctacccttcatacagggggagctatttggaagaaacaaaagccagaacgagcaaaaaggttaaagcccagaagggataacaagcccggggaactggggggagcgggagaaaaaggggaaaaaaaaataaaaaggaaacaagggaaaa

SEQ ID NO: 17083 - DNA, 191 bp, Homo sapiens
tagagaaatcaaacaaccatcaaagactactgttttgtgaactagaaaaactagaagagatggatgaattcttggacacccctattctcccaagactgaaccatgaagaaatcgattccctaaacagaccaataatgagctccaaaattgaatcaggaataaatagccaacaaaccaaaaaaaaaaaaaaa

SEQ ID NO: 17084 - DNA, 158 bp, Homo sapiens
ggggaccaatggtgtgcccagagcacttctctcaaaaacactagtggtagcaaggcggcccgggctggggagccgtcgccggagtccttggaagccttggctttagaattaccaagccccggcttcccgctggcagggccccggtctccggtcggccc

SEQ ID NO: 17085 - DNA, 105 bp, Homo sapiens
ccagctgacttttagggaaatttcattgggcttcttcttttaacactgcattatgcagtttgggggggtggggcttctcatgccggagactggtgccgctggatg

SEQ ID NO: 17086 - DNA, 309 bp, Homo sapiens
atttggcactaaaaagaagaaaaggactaacaagctttcttttatgaacaactattttgagaacatgccaatagtatgtgtttattactggcttaatggagtaatggcactcttattctttcttgatagaaacctgcttacatttaaccaagcttctattatgccttttctaacacagactttcttcactgtctttcatttaaaaagaaattaatgctcttaagatatatattttacgtagtgctgacaggcccactcttcattggaaggggatgaaaatcaaataaagaacccctcacatgaaaaaaa

SEQ ID NO: 17087 - DNA, 292 bp, Homo sapiens
ttctgtctcctcatatctaaaacgaggaagcgaacttttactctgaggtctcttctggctccaacagcggatgaaaacagggggaattcggacctgaatgcttacagagcttcgttcccacatatcccacaagatctaccgtaaagtaggataaaatcgtaactttttggagggtgagatggggcggggatcaaggaattatgccattcaagaggcagatgaaaagctgggcacagtggcacacacctgtagacccagctactcgagagggtgaggcaacatagtgagatac

SEQ ID NO: 17088 - DNA, 226 bp, Homo sapiens
aaggcgctttggctaagctggtggaagctatcaggaccaatttcaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttc

SEQ ID NO: 17089 - DNA, 439 bp, Homo sapiens
aaataaggaattatctccctagcttctcattacagcatctctaattgctgtacactttacagatgaaatacaaaggacaagctctactcctataacgtgtactacaagtttctctaaaagtactgacgtatttcagctgaactcttgtatctgcagacttttgatatttctgcaggctacacccttaacttgcagaggccatttagttgaaagtttgagccgaagctgatggtaaaatgccccaaactccaaggcagattgtctgtataatacgctatagcttttcaccatgtggtgttaccagctgtactctgtatttaaaaagccagagattcttctggctaaactggttctatagcatttctaaacaaaaaaaatggttttttcttgcctggaataagatggaaatccattcccgctggggtctaaggggcaagaa

SEQ ID NO: 17090 - DNA, 467 bp, Homo sapiens
tccaggaattcatggcctttgttgccatggatactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagcaggctcagtgataaagcgtgcaccgtgcagcccgccatggccggtagaccctaacccggagggaaccctgactacagaaattaccccggggcacccttaaaacttccactacctttaaaaaacaaagccttatccagcct

SEQ ID NO: 17091 - DNA, 418 bp, Homo sapiens
gagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttggttaaattccatctgttttggaatatctagctctatatggaaatgatgggttggtgggatttaaaatgaatccaccttgaatgtaattaaaggctggttttgggagcgataaactttaaatatacttattaaaa

SEQ ID NO: 17092 - DNA, 473 bp, Homo sapiens
aaagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctattgggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcatttggtc

SEQ ID NO: 17093 - DNA, 133 bp, Homo sapiens
ggaaaactagaaccaaagctggttcctttggtgattgcatttaggtactgggcaaaggtaggcttgaggtctttatgcatgaatacattctacatatgtataagcagtatgctttgatttttacttaatttaa

SEQ ID NO: 17094 - DNA, 278 bp, Homo sapiens
aagagcaaataaaacaatgaagttaccatttagtaagatgggaaagaaggtggcaggaataaatttgagacaatgaagcagattatgagttaagtttaaaatgagatgacagaagggcaattggatacaactatgagattcagggataagacttccttggagattagaagttgagagtcatcagtttatggattgtatttaaaactgttgacttgagaaaagtgacatcagcaacatggaagaccaggatgctcccagtccacaccacccacagatgt

SEQ ID NO: 17095 - DNA, 195 bp, Homo sapiens
gaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 17096 - DNA, 507 bp, Homo sapiens
gaagaacgcaaagctgagaacatggacgttaatatcgccccacttccgcgcctgggacgatttcttcccgggttccgatcgctttgcccgaccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgtcgttatggtggtcatgttggcgagctatttccttatctccatgtttggaggagtcatggtctttgtgtttggcattacttttcctttgctgtgatgtttatccatgcatcgttgagacttcggaacctcaagaacaaactggagaataaaatggaaggaataggtttgaagaggacaccgatgg

SEQ ID NO: 17097 - DNA, 109 bp, Homo sapiens
ttgcattccgaggacattacttctggatgctaagtccattcagtccaccatctgcagctcgcagaattactgaagtttggggtattccttcccccatggatactgtttt

SEQ ID NO: 17098 - DNA, 374 bp, Homo sapiens
attctgaaatacctttgtttttttcttaccctacatagcttcaaaagggattttttttttttaaactgcctgcttcccggtttaataaaatattaggaaaacttttataaggttttgtaattggcaaatatagtcaacatatttaggcatctcactcttatatatgaaataaatgcaactttcttccatttaaaaaagtggcaaatgccagcatgccactaattttagtcaagaagcaaatccacatttaagaaaaacgtgattttaacatttatattatgtttataatctagatgggtatacttctttacactgctctagctgtgttcattgcaagataggaaattcttctgaaaacctttactgaactactg

SEQ ID NO: 17099 - DNA, 264 bp, Homo sapiens
ttcacaacttggtgaaatggtcacctgtctcccaataagctatagacagaaaaaaaattacttggtgcatggcttgagtttccaaagaaaaggaggaatgaactcacttttgactaagtgtttgaacactaagcttagtgtcaaataatgaatctttgtggttctatataaccattttcttataaaaacattttcctatagttatatagctttctagaaaattgcctcttatttttgacatacgagtttggaaagtagtactgg

SEQ ID NO: 17100 - DNA, 441 bp, Homo sapiens
atgaggaatgaacctagctcctattgcagtttcaataacattggtggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggtgacactgtgcactctaacctgcttacacaagcaacactattgtacagaa

SEQ ID NO: 17101 - DNA, 503 bp, Homo sapiens
aaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaaacccacttctaccaaaaagccaaaaacaatgcctagagtgagagaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaaggaaacagctaaaccaaaagacagagctactaattctaaagcgaaaaaa

SEQ ID NO: 17102 - DNA, 408 bp, Homo sapiens
atcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagcttactactgtggaaagacaactgttttaataaaagatttacattccaca

SEQ ID NO: 17103 - DNA, 310 bp, Homo sapiens
aatctgaagaatgaagacatgtgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattg

SEQ ID NO: 17104 - DNA, 500 bp, Homo sapiens
aaaataatctgtattttatagaaaaatattggtaacaatagttttatggtttttgttaataagtcataaagccttccttgtggtttttcatcaaatgtttctcatggttcccataaacagtgctggaacctggcaacctcacatgctttacctagatataattttcatttgactggtatagacaaaggcatacatctcataaaaagatcaaagccacttaaaggagataccattataatgaaaatatttgtgtaaccaaagataactaagtctcaaaagagagcccattctcagaagctgtgttcaacaccaagaaatgtccatgcagtaaatgaaacagaaagccctcaagattagcttcattggttgtggatttggtgctgtaattaagacatgaaaaaaaatatatatgattttaaaaagagagcttagaaacataatatggtggtgaaataaataatgtcacccatctccccaagagaagaggcagtcttagcttc

SEQ ID NO: 17105 - DNA, 541 bp, Homo sapiens
ttgaggcagccagcgcaggggcttctgctgagggggcaggctgagcttgaggaaaccgcagataagtttttttgtctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgctttagattaaaatgaaggtgacttaaacagcttaaagtttagtttaaaagttgtagggtgattaaaataatttgaaggcgatcttttaaaaaagagattaacccgaaggtgattaaaagacctttgaaatccatgacgcaggggagaattgcgcatttaaagcctagttaacgcatttactaaac

SEQ ID NO: 17106 - DNA, 124 bp, Homo sapiens
caaatattagaactcagatctctactaatagtcaaatatgccttatactacacaccgagtttactccctgagagccaggtcatatacacttcctggacctgtgagaaatatttgggctaatacc

SEQ ID NO: 17107 - DNA, 235 bp, Homo sapiens
gaaatgcccaagaaccagcttggaccgggacgtgtagatcttgaccacagtccattgctcaggctcacataggcacatgccaagccggggaacccaacgtccttcacgaacgagctgaacaagagcaaccaggggaaaaaattacccgcccactgtcgagagctatgaccgccctgggaagctccataatgtgggacacgtctcatcgccgaggaaccggggactatgaagagaa

SEQ ID NO: 17108 - DNA, 327 bp, Homo sapiens
ccaaatgatcaaagctggaagtattatactactggacttcaaaccatattataaggctacagtaaccaaagcagcatggtactgttacaaaagcagacacatagaccaatggaacagaacagagaacttaggaataagaccactcctctacaaccatccaatctttgacaaacctgagacaaacaagcaatggggaaaggattacctatttaataaatggtgcttagagaactggctagtcatatgcagaaaactgaaactggatcccttccttataccttatacaaaaattaactcaacatggattaaagacttaaatgtaaaccc

SEQ ID NO: 17109 - DNA, 186 bp, Homo sapiens
atttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaa

SEQ ID NO: 17110 - DNA, 461 bp, Homo sapiens
gggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggggtttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggatcaatcagctgtgtatgccaaagaatagtaggttt

SEQ ID NO: 17111 - DNA, 481 bp, Homo sapiens
cagaaaggacatccacaccaaaaacccatctgtacatcaccatcatcaaagaccgaaagtagataaaaccacaaagatggggaaaaaacagagcagaaaaactggaaactctgaaaagcagagcgcctctcctcctccagaggaacgcagctcctcaccagcaatggaacaaagctggacggagaatgactttgacgagttgagagaagaaggcttcagacgatcaaactactccgagctacaggaggaaattcaaaccaaaggcaaagaagttgaaaactttgaaaaaactttagacgaatctataactagaataaccaatacagagaagtgcttaaaggagcagatggagctgaaagccaaggctcaagaactacatgaagaatgcagaagccttaggagctgatgcgatcaactggaagaaagggtatcagtgatggaagatgaaatgaatgaaatgaaatgagaagggaagtttaaa

SEQ ID NO: 17112 - DNA, 185 bp, Homo sapiens
gaaaagtatagtccagaataatccagggtgcagccgcaccaggccgtgtaggagggggttgtggttcttcatcaagtgatacccacgcatcctatcttcatgacacagtgcctgagaacatctacagcatagacaagaagtacatggcggataactgctacttcaggaggactactctcatctga

SEQ ID NO: 17113 - DNA, 212 bp, Homo sapiens
aaaattaatagcacagcagtgttttaaccgtctgcacaagagggcagcagacacgttggtttgtgtagcagagaagagggagaaagccgcatcttgcctggatgagccaggggacacagaagagaagcccactatctcatttttataacctggcaaaatcttgttaatgtcattgctaaaaaataaataaaagctagatactggggaaaaaa

SEQ ID NO: 17114 - DNA, 396 bp, Homo sapiens
gcatttcttgccattaaatatctacagaaacataatgtttaacgacctcatactattgcattatgtttgtggctcatacattattgaaacattcccttattcttgaacattaagatgggcttaggtgaagagatagagtttgtaaaaaggctgttatgagtatcctcatatacgattgtaccgcatatccttggacaagttcaagtaaaaggatataaacatttaaagtaactaatactagtttaatgaagtgtgtgatctcaatgctaataaagtattagatattccaattcacttgggggtaggaatcttctgatgtatggagtgtttttatgtaaatgagctcatgtatcttgcttcaacttaacgattatattataaacatctttgtatgcc

SEQ ID NO: 17115 - DNA, 600 bp, Homo sapiens
tatagactaccaaatcagtgaaccaaaaatagaaattagatttgtgcaaacatgcgtagaaatctactgaattgggttccagattttaaattttatgtgatagaaatattgactcagaccatattttttatgatggagcaactgcacggtgattgcagcttttggtaatatgtctcttttgccttttccagcgcctatttgctttaatgagaatagaaacgtaaactatgacctaggggtttctgtgggataactagcagtttagaatggaggaagagcaacaaagacatgcttgccatttttttctttacttatctctcaaaacaatattactttgtctttgcaatcttgtactcttaactggtaaaagaagtggatggtgtatttcaagatgcagaaatacttacacgtgaatattttgctaaaaaaagcatatataactattttaaatatccatgtatctttggatatctaagactcatcctgatttttaccggcacacatggaacaaagccttggaacctgccttatctaaggggggatcatactcttctaaaacttgagtggctggcttaaaagatataaggggaaagaaaaaaa

SEQ ID NO: 17116 - DNA, 206 bp, Homo sapiens
accaaaagaaagctcatctagctacaccttgacaaacaaggaaaaaatagttacaagttagaggggacatttcattaaagttgataaaagactcaattaattaggaagacgtaacagttatatagttttatcacctaattacattgtctcatatataaaaagcaaaaactggcagaagtaaaaggagaaatggacaaattcgcaga

SEQ ID NO: 17117 - DNA, 140 bp, Homo sapiens
ataatcatgttctgggtattatatctatctgtgtttaataaatatatacattttaatttattatgtgtctcacatactatagaaagatattagtatgcatttaataaaacatattcacttggaaaaaaaaaaaaaaaaaa

SEQ ID NO: 17118 - DNA, 259 bp, Homo sapiens
taaagataatgagaagaattataaaagcttccagagagtttaagtaagctattttaggggaatgagatccaggtcagctcagaagttctcattaggaatactggatattttataacctaaaatttgtcaaatatgacagcaaaatgaaatttggaaatgcaaggactcagaatgtttatcttttgactgcccctttgaaatgaaattactagggaatatgctttaaaaaaatgaaaaaagaatcccaaaataaaaaaaa

SEQ ID NO: 17119 - DNA, 653 bp, Homo sapiens
taaaagagaagagtacgtaggtttattataatcaaactattgaagaatttacatattagttatgagagctgggggtagatcttcccaggagacaagaaagaaattaaaaagtagaaaatattaaagttaaataatgtagagaagagagaaaagcatgcctaaatacaaataataagaatttcaggagagagaaaaaacccaatgaaaaatggttgagaatatttttaaaattagacaaatgtttcagagctaaaaaaacaaaaaggtgacagcaacctacttaaaagaaccagttccttggaggaatgcctgattctaggcctgaaactgagcttggaatcgatagcaaactactaatcagaaaccattaagattgggtcatgtttcaggtccaacttgaagatgctccactggctggctaaggatatgaaacttgagtattaacaagaataacttcagtagattgatatgtatcaattatatctaaatccatgaatttctaagactactctctctctacaacaaaaattggtactggtgggaggatctagggaagccactcactttaccactgattctgcctttctatttaaccgtgctttaggtaatcaataatagatgagttggtcttattagaataatattccgctatg

SEQ ID NO: 17120 - DNA, 586 bp, Homo sapiens
cgacaggagaaggatgtgtctacctccagacatacttttaatacaatatgtctcccataataggacaagtggcctttgctttaggagtgcagactctgcctcaaacttgtgatgaacccaaagcccacaccagcttcaaatctccctaagtgtcagttacacagggagccgctctgcctccaacatggcgatcgttgatgtgaagatggctctggcttcattcccctgaagccaacagtgaaaatgcttgaaagatctaaccatgtgagccggacagaagtcagcagcaaccatgtcttgatttaccttgataaggggcaaatcagacactgagcttgtcttcacggtctgcaagatgtcccagtaagagatctgaaaccagccatagtgaaagctatgattactacgagacggatgagttgcaattgctgagtacaatgctccttgcagcaaagatcttggaaatgcttgaagaccacaaggctgaaaaggctttgctggagtctgtctcagagctcccagaagaacgtgttttggatcttaaagactgatgaataacacttttttgggcaaaaaaaaaaaaaaa

SEQ ID NO: 17121 - DNA, 634 bp, Homo sapiens
gcataattgatataagcgagatccatgcacatggagtttggaagagggatgatcccactggtattgatatggggggtcaaccacaccagatgtgataaaaataggaacgaggctccaggaatttttcacacaacaattggataccagcaaacgagctctgtctacctggggaccagttccttaccttccgccaaagacaatgactagcaacctagaaaaaagttcacaagaacaatgtaagaattagaatacttgatgcagcacatcatcgacactggctggagtattgaaggtggtatcaggatgccacatatccttatttcagattccattaccagaagatggaatgcaatttggaggatcaatgagcttacatggaaatcatatgacactggcatgttttcatggccaaattttcgtcaaaatcttgggccctttttcatttagaagaaccaaatattgcttttggactgaagctcaaaaaatctgggaagaaggctccagtgatcattctacatatattggacaaacactagaatttcacctgggcataaaaccatggtaccaaaaccatggggggcttggaaaggcccatggcaccataaccaagatacaagggggcgccttgaaaaat

SEQ ID NO: 17122 - DNA, 403 bp, Homo sapiens
taaaacactaagcaattgtcccatttttttaactgcattttcttcacaattcagccaatgggccattcctgccataacattgggcatcaattgatcaatatataaccttgtttgtatgagggcttatgtacattcctgttgaaggacaccttatataaaatacatatcgcacatgcaataacactgaacaaaaggccaactgacctgtacgttacgggggacggaagcgagaataacacacacaaactaggatttattgcagaccagagtggactccagagcatcagagacacccgagccaagctcagccagccagaaaacgtggtattagaccacgagttgacgaagctggaaaagaacttgaaggtgtataactaaggctatttataagtccagtgaggaa

SEQ ID NO: 17123 - DNA, 266 bp, Homo sapiens
gcaactatttgccactgtttcaggcttggccagcaggaggtttatgatgagcttgcctatgtcatagacaagcggcggatttacgacagagccctggccactccgcaaaggcagttcatccttggagtctcaatgtgccggtctgctaattgagatatgcttgaagtatcagccctaaatagtctgattctgtgacctacaaacccttacttaattcagtgttactataaatgatccttcccttaaacctactttttacttcaaaa

SEQ ID NO: 17124 - DNA, 201 bp, Homo sapiens
cccctgtagcagcattactgagggtacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttccaaaaaaaaaa

SEQ ID NO: 17125 - DNA, 597 bp, Homo sapiens
tcttgcctggatgagccttttgacacaggaagagaagcccactatctcattgtggtctttacaactctcttgcaaggttccctggttgtgaaaatacatgagataaatcatgaaggccactatcatcctccttctgcttgcgcaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggccagtgttctgatttgggtctggacaaagtgccaaaggatcttcccctgacacaactctgctagacctgcaaaacaacaaaataaccgaaattaaagatggagactttaagaacctgaagaccttcacgcattgattcttgcaacaataaaattagcaaagttagtcctggagcattacacctttgggaagttggaacgactttatctgtccaagaatcaagtgaaggaattgccagaaaaaatgccaaaacttttcaggagctgcgtgccccttgaaaatgaaatcacccaaag

SEQ ID NO: 17126 - DNA, 562 bp, Homo sapiens
ggagtttgcaggacaaaaattaaatttttcatcctccttgttctagttttcttaacaataagctttcagttgaggcttcaggtggcagggaaaaagcagaggtaggcctggtcttaccagggcaaccacctaacgtggactcaacaccatctagtggtttaacagaaagaaggctgaaccttctgtggagacagataacaccatcaaatctttgcaagtttttatatacaatcaaagactaaggagctaccaaaggacaggattacatgactagaacaaaagggaaaacagttaataacagatccagagatgatccacatcattcaggtttattagatgaaacctattttcagtaacaactatgtcatgaacatagaggacgtatggagaaaattgatgtgaaatgaagaatttcattagcacattggaatggctaaaaggattaaatggaaattcaagaagggaataatcagtatctacatttaaaaactcattagatcctgtatagaagattagaccatcagaaacagggtatagaaaatatcaactgaagcattaaaaa

SEQ ID NO: 17127 - DNA, 214 bp, Homo sapiens
gaagtgtattccttgatgaaagaagcacagggtcctaaactgaggcaatatctagttgcctacctaccaaccattgccatgaccagacagatcacagccggagtctaccagaggtttaaggaggagctgggccattccttctgaagctattccaatcaatagaaaaagagggaatgaggccagcatcatcctgatccaaagcctggtgggcccc

SEQ ID NO: 17128 - DNA, 216 bp, Homo sapiens
tcgaggattgcagccctgaggctacgagctgagggggcattgcagagctgagaggaaaccgcagactacccttgggctttctgaaggaaggagattaagtcaaactactcatgaaatataggaaatacggtactaagatattgcttagcggtaagtttttaacgtaattttaatagcttaagattttaagagaaaatatgatgacttagaagagtt

SEQ ID NO: 17129 - DNA, 350 bp, Homo sapiens
caacggaaataattaggccactaaaatctcttctcttactgtctataaaaaaattccatttttgggccaggcgcgggtgtctcatgcctgtaatcccagcactttgggaggccaaggtgggtggatcacgaggtcaggagttcaagaccagcctaaccaacatggtgaaaccccatttctactaaaaatacaaaaattagcttggtgtggtggtgtgtgcctgtaatcccagctactcaggaagctgaggcaggagaatcgcttgagcccgggaggtggaggttgcaagtgagccgagatcgcaccactgaacgccagcctgggcaacagagcgagactctgtctcataa

SEQ ID NO: 17130 - DNA, 446 bp, Homo sapiens
gtgctagaaaaatgtctatccagccgtgacaagacatgcaaaatgtagttgcatattactaagggaaagaagctgctctgaaaaggctgcataggatgtgattccaactgtatgacattctggaaaaaacaaaacgatggagacaggaaaaggatcagtggttgctaaggggttggggagagggagggatgaataggctgcgcacagagggcttttagggcagtgaaactactctgtgtgatgctataacgctggataagtgccattatgcatttgccatacccacagaatgccagcccaagggtgaacactaatctaaaccatggaccttgggtgatactaatgtgcccacataggtcatcgattataacaaatgttccattctggtggggatggtaggcctgtccttgcattgtaataaagaaaacctgagattgagtaattag

SEQ ID NO: 17131 - DNA, 650 bp, Homo sapiens
aaaagtacaagcatcattgttgtagaatgtgtgaaaatattgtgcgacatcttggaggttagtacatcctccttaaatagggcataaaacccagaagcccaaacatttgattacataaaactaggagtttctgtgtaactaaatgcagaagttaaaaacagatgaaatggtaaaagaaaatacttgcatgtgtaacgtgtaagcattagtaaagatactatatagacatataatgagtttctacaaatacataagaaaaagacagcctagttaaaaaatgagtaaaaatatatatgtatcagataggtaactcacaggagaaatagaactggccaataaatgctcaatcttactgcagggaaatactgatgaaaataaagagatatgattactccccattcgttggcagaaatgaagaacattaatggtttcaagtggggggttacattggtaaaggaggtttggagacagtttggtggtattagaaatagaaattatacttatttcagtctagccatgtagcctgagaaataatgtcatagaaaaatccttgcccttgaacccaaggatatttcaaaatgtccatatagggctggtttttacagccaaatactggaaccagtcatctggctttaagaaggaaccctttt

SEQ ID NO: 17132 - DNA, 557 bp, Homo sapiens
gtgtaccctgcctttgaagcacctcctcagtacgttttgccgacctatgaaatggccgtgaaaatgcctgaaaaagaaccaccacctccttacttacctgcctgaagaaattctgcctttgacaataaatcctataccagctttttgtttggttatgttacagaatgctgcaattcagggctcttcaaacttgtttgatataaaatatggtggcttttggttaagcatttattttcaaacactaaggagctttttgacatctggtaaacgctttttggtttttggtaagtctttacattttaatagttttgaagacaatctaaggtaagcaagagcaaagtgcattggttgccttaattggggggtgggaagggaaagagggacttgcccataggttcccttttaactgcacttctttatataatcggttggattttggtacttgccaacctgagtaccttcaggaagactgacttaaaaatccgggtggagtaagaggtgggaataagaaccgaactttcatctgcagaggcaagaaaaaaattgaaattgggact

SEQ ID NO: 17133 - DNA, 175 bp, Homo sapiens
tgtcgaagcccccatcgctgggtcaatagtacttgccgcagtactcttaaaactaggcggctatggtataatacgcctcacactcattctcgaccccctgacaaaacacatagcctaccccttccttgtactatccctatgaggcataattataacaagctccatctgcctacga

SEQ ID NO: 17134 - DNA, 615 bp, Homo sapiens
cagcagggctgtggctaccatgttctctcgcgcgggtgttgctgggctgtcggcctggaccttgcagcccgggtggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgagggtgctacactaacagcagctgggaaagaagttatgcttggtggaattggtgacaaaatcagaggcatctttataggactcattctgaccagtttctggtgggattcaaagaaagtgggaaagaaagcccctcactttttggagatgcgcagtcattggcccttgaattactaaatctggatatgaatttgatgaaggctccatcatctttaataaatcagggctgcatctcccataaaaaaaaa

SEQ ID NO: 17135 - DNA, 540 bp, Homo sapiens
aactaacacaatttttatcaggattattcccagttactaggtttgataggaggaaggataagggagcagtgaatcctaggcacctgggacaaaattggggagggagtggaagaggaaaaactataactgggagatttgaaatgacaatagtaaattttcatttactatgtatttatatttataattatttttacttatctcatgtttttccctttgggcaggtttgtgcttagctcttgattatttacaaagcatttcaggaaaagcaaaccagcaaaacccccaaaaattatcctttggtattagaatgcatttggcaaattaagtggtacatatacacatttaatttaattctttctttctaatataaaggttgtggcaattggttgcacatttgcctttggtagagttggttgggaaaagtggaaatatgcttaagatatgaaacatctggttatttaatgatatttactgatggcaagacagacttattgagccctggggcagtatttttgtgagggatggcatgcaccttgcctg

SEQ ID NO: 17136 - DNA, 313 bp, Homo sapiens
caatagatatagtaccgcaagggaaagatgaaaaattatacccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaaaaaaaaaaa

SEQ ID NO: 17137 - DNA, 609 bp, Homo sapiens
tgactgtgacaaaagagtagccatcaagaaaattgttcttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctcgggggctcaagtatattcactctgcaaatgtactgcacagagatctcaaaccagctaatcttttcattaatacggaagacttggtgctgaagataggtgactttggtcttgcacggatcatggatcctcattattcccataaggggccgtctttctgaaggattgggtactaaatgggacagatctcacgtcttttactttctcctaataattatctaaagccatggcatgtggctgcaggctgcatctttgctgaaatgctgactggtaaaacccttttttgcaggtggatcaaagtaagaaggacgggagctttg

SEQ ID NO: 17138 - DNA, 570 bp, Homo sapiens
attcctaaggctgcaaaggggacagtgggatctatattggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatcgatctctaataaatccagatagatatatcattgtggtggaacatgatctaagtgtattagactatctctccgacttcatctgctggttatatggtgtaccaagcgcctatggagttgcactatgccttttagtgtaaagagaaggcataaacattttttttggatggctatggtccaacagaaaacttgagattcagagatgcatcacctggttttaaaagggctgagacagccaaatgaagaagaagttaaaaagaagggatggataaatatcccggaatgaagaaaaaaatggggagaatttgacctagcaattgg

SEQ ID NO: 17139 - DNA, 640 bp, Homo sapiens
ggcactgacctcaactttgagttttaatgcttcatggaactccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggccaaagttgcaaagattggcactgatgttctatcaactcgatatgaaacccgctcatctatggcccaatagaatcaacaatttacccgatatcaggtcttctttagactgggcttatgacctgggcatcaaacacacatttgcctttgagctccgagataaaggcaaatttgggtttctccttccagaatcccggataaagccaacgtgcagagagaccatgctagctgcaaatttattgccaagtatatcctcaagcatacttcctaaagactgcctctgttggaataagccaattaatcctttttgggcctttatcaaaagtcaatcttcagttttcccaaatgcacttctttttaacctgaaccttctcttggtcatttaaggcccatgtac

SEQ ID NO: 17140 - DNA, 549 bp, Homo sapiens
tcaggaacgagatggcggttctctggaggctgagtgctgtttgcggcgccctaggaggcccgagctctgtggcttcgaactccagtggcagacctgctcatatctcagcatttcttcaggaccgacctatcccagaatggtgtggagtgcagcacatacacttgtcaccgagccaccattctggctccaaggctgcatctctccactggactagcgagagggttgcagtgttttgctcctgggctgcttccggctgcttatttgaatccttgctctgcgatggactattccctggctgcagcctactcttcatggcactggggccttggacaagttgtactgactatgttcatggggatgccttgcagaaagctgccaaggcagggcttttggactttcaagctttaaccttgctggcttggtatttaactatacgatggggcatctgcaaagctgttgccatgctgtggaaccctgacctttttgactcatactttgaagaaatgatggatgcctctttgccttgcttggcaatgccattaagctcac

SEQ ID NO: 17141 - DNA, 114 bp, Homo sapiens
atactgccatttataatagcatcaaacagtgtaaaatacctgaggataatctgtccacatgtgtgcaaggcctgtacattgaacaccacaaaacattgggcctaaaaaaaaaaa

SEQ ID NO: 17142 - DNA, 530 bp, Homo sapiens
aaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgcatgacaaggaaacttacaaactgcacgcagagaaactattaaaggtattcagaaacgtgaagccagcaattgttcgcaattcggcattttgaaagcaaatttgccggggaaccttaattggtcttgaacagtcaagaaaacattattgaggaaaattaatatccagctaaccccaccttacattttgtgcagggatattttttaaggcttcttcatgtaagtagcaacagggcttactatcttttcatctcattaatcaattaaaacctttaccttaaaattttttcttcgaaggggggggctttttattggaa

SEQ ID NO: 17143 - DNA, 470 bp, Homo sapiens
cttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgctttgtctttggtcattagggagctctaatgtgtgtttgtggctccaagtcacattttgtgtttcattgatctatatgtatatatgtgatgttttcatatatatatgtgcgtgtgttaaattttgtatcatcaggactgcacccaatttgacactttttgtatctagaagaccctccaaaaaaggaacccataagcaccaagaaaagaggctatgatgtcttagcatttgctatcatgcctatttttatctagatttttaaatgtagctggcataacaaaattttaattacaattggctggatgagaagaaaaggatttt

SEQ ID NO: 17144 - DNA, 403 bp, Homo sapiens
atggtctcgatctcctgaccttgtgatccgcccgcctcggcctcccaaagtgctgggattacaggcgtgagccaccgcgcccggcctagagatgttgaattttatcaaatgctttttcagcattgaaataatacggttttcattcttgattctgttaatgtgtcatgtttattgatttgtgttcacagatgacatgatcttatacctagaaaatcctaaatactctatcaaaaaacttagagttgctaaacaattcagttaagttgcgggttgcaaaatcaacatacaaaaatcaatggcatttatatatgccaacagcaaacaacctgaaaaagaaatcaaggaggcaaccccatttataatagctataaaaatataaaataactaggaatcaatctaactt

SEQ ID NO: 17145 - DNA, 590 bp, Homo sapiens
tggccgggaacctattgctagttaagattttcatagactacacaagaaagaataatcaggcaaatccttaagaataagagcaatttaggatgactagccctacaagattttaaaaaggattcattagtttaaaaaatgtgatgtagatacatgaataaaataaaatcttgaagtagatccaaatatacatggtcagattgaatacaataaagatggcatcgtagcagtggagaaaagaagaattatttcataaaccttgttggaatggctaggcaatcatctggaaaaaaatgaagttgaataataaaaatatattctacactagcacaaattataaataaagcagtgatttaaatgagaaaaattaaatcataatgatttcaaagataacataggataatttctttatagtcttctaaaatatatgactttatgaattctgactcaaagcccagaaggcataaaaatgtacaaaaataataaacatttgtgtgacacataaaatgagcaaagtagaaatgttgcacctcaattcacaaaggaattaatattctttacttataaggaaatcctagatttaataattaaaa

SEQ ID NO: 17146 - DNA, 157 bp, Homo sapiens
cattaagtcatctgacattaaatcatttagccactaagttatttgtctactctcactttaaactcaccaaagaagattctcttaaagaaattatgaaaaatggacaatttaacattttaaataaatagtgacagaggtcattaaaaaaaaaaaaaaa

SEQ ID NO: 17147 - DNA, 545 bp, Homo sapiens
  misc_feature 446: n = A,T,C or G
atataaaggcggtataggtatatgttccaaataattgcgttccacacatgttaagtgatatgctaccgggctgaaacttgctctttccaaaccattgttcatcctttaacttctttacactatcaaaaactctatttaaaaatagagggctttcagaagaggacatacaaaaacaaacaaaagtctacataggggtaacacaaccatgagattagtaaataatgcatatggctagcacataatttgacaccttataaaacaagaatctggctatcttttccttcctcccaatatttcttcatttgtatgctcaggtttctaatactatttcacatgcttagtcattgactctttcatcgccttccctcagaaaaacctgctccgctaaagtaaactaagtaactcaatattctttattttgggttggaacctgctcaatgttttgngtccatattaagaagtcaccctataaatctaaactttggaactctaatttatttggcccatgatcatacaaagtgcttttaaacttggtttaaaaaatg

SEQ ID NO: 17148 - DNA, 600 bp, Homo sapiens
tccatctggatgctctgcaaatgtatatattagttttgatagagacaataaatccttttgtaattactacaaagcttataccatttgaattatttctatagttctcatatcattccttacacaaatggactgagagtcaaacaacagaaatatgctcgacttataaccttactctcatatggctaaaactagtgtctgaattgtttttaattatttttaatcatttcccaacatcaagggtaaggaaataaaaaccaacaggcacaaattaacaggttttttaaattgttgtttattttttgttttttgaaatggtgtctcgctccagcctggacgacaagagtgaaactccatctcaaaaaaaagaagtcaagttagagatatactaattttttagtaagtatattttataggtgcttcatttataagataaaggttctgtaattgggttctcattataatgcattttcttggtagaatattttaccggaccttccttttttataaaatagaaaacaggtagaatccttttattaaaagaaaattaggctggcccggtggctcaccctgtatccagcctttggagcccgaggccggagg

SEQ ID NO: 17149 - DNA, 639 bp, Homo sapiens
aaccgatcgaccgggagaagacttgcccactgttggctacggggtgttcaccacatataacggtcgccaccacccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttggtgaatttatttttccgcagttatgtaaaataaacatactcttcttcctccctgattattgccattaagcctttaaatctaaacaaattataatgcatcatctatttaggagttagattggatgtgctattgtatgattacgaatagtctgatgttcaagccctctgtaaaaatgaagaaagtgccttagcatctggggaaactgtact

SEQ ID NO: 17150 - DNA, 606 bp, Homo sapiens
ataacaaaaactccctcattagctaccttgagcatatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagcattttctgaaaggaaagaagaggagaaggaagaattgatggaatggtggaaaatgatgtcagaaactttaaatttttaaaaaggctctaggtagctgcttaaatctatctatataatggaggatgatgtaatgggggctttttttagaatttgggcaggtaatacttaacattgatttattttttaatcattaaatattaatcactttccttaaaataaatagcctcttaggtaaaaatataagaactggaatattcattctcttatataggatcatttcccaccttttttacacaaaaagtttgaaaggattaagtattttgccctccaggc

SEQ ID NO: 17151 - DNA, 162 bp, Homo sapiens
  misc_feature 1: n = A,T,C or G
nagaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagggaaaaaaaaaaaa

SEQ ID NO: 17152 - DNA, 390 bp, Homo sapiens
tacctaccagaacctcgacatgtagacgttatctgccattgagcgccagctgggccgagacccacacagactcagagtcgtggtggtcaccggcgagaaaattgctcaccggatctacagtctagattagctgagtgagaaaggaatattaagacgactcatggatttgatcaagaaaaaatgacgctctttgccgttaccgttcactgttcacttgcactatccttttatgctgccataaacagcagctgcacgcatactcttgctgaaatattgataatagcccaggcaggtttgtgaatttatggcccttcgcataaatcagagagctggggccctgcctgaattatattcaaaatagaactgcctctgctttaaaatggatggaat

SEQ ID NO: 17153 - DNA, 637 bp, Homo sapiens
  misc_feature 481: n = A,T,C or G
gcatttcttaggacacctttggattaataatgaaaactactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggcgggggccaaaaagagtgctgaatttttgctgacatgcttaaaaacgcagagagtaatgctgaacttaagggttaagatgtagatctctggncattgagcatatccaagtgaacaaagccctaagatgcccgccggacctacagagctatgtcggattaacccataatgagctctcctgcccattgagatgatccttacggaaaaggacaaatgtcctaaaccaaaagagaggtggccaaaaaaaaaa

SEQ ID NO: 17154 - DNA, 440 bp, Homo sapiens
ctacaggtcatttgagtcttcacacaaataataacttatctggccaggagaattatctcagaacagaggtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgctggcaccaagtgtcagcctcagcactcccgggactattgccaagaaggggcaagggatgagtcaagaaggtgagacccttcccggtgggcacgtgggccaggctgtgtgagatgttggatgtttggtactgccatgtctgggtgtgtgcctattacctca

SEQ ID NO: 17155 - DNA, 349 bp, Homo sapiens
ttcaaaaattgtattacatgtttttattaataatgtaatatgtaatagagaggccgggttgttgagaatgccaaaatatctgaccaaagcaagcatactgtcttttaaaaattatttaacagacgatcgtgtgctggctaaattttctagtgtagacacccattgttggaagcctttgtaataatcctttattaaggttaatgataatattaattccaaaggacatatttcttaaataacaaaaccaaaggctttgtgtctgtctttaagaatgaaggataatgtcctactttatcaatctggatcaataaaatgtagaaacaaatggaaattttagctatatcataaw

SEQ ID NO: 17156 - DNA, 589 bp, Homo sapiens
ggagcctctctccctactgctgctacacaagaccctgatactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctgcacctgattttgtatccccctgtagcagcattactgaaatacataggcttatatacaatgcttctttcctgtatattctctggctggctgccccctttttcccgccccagattgataagtaatgaaagtgcactgcagtgagggcaaaggagaagcaacatatgtgattggtccat

SEQ ID NO: 17157 - DNA, 668 bp, Homo sapiens
  misc_feature 583: n = A,T,C or G
gatactcctcgagaagagcaactccaagacacataattgtcagattcaccaaagttgaaatgaaggaaggggtgttaagggcagccagagagaaaggtcaggttaccctcaaagggaagcccatcagactaacagcagatctctcggcagaaaccctacaagctagaagagagtgggggccaatattcaacattcttaaagaaaataattttcaacccagaatttcatatccggccaaactaaacttcataagtgaaggagaaataaaatactttacagacaagcatatgctcagagattttgtcaccaccaggcctgcctaaaagagctcctgaaggaagtgctaaacatggaaaggaacaaccggtaccagccactgcaaaatcatgccaaaatgtaaagaccattgagactaagaagaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtntcaggaacccatcttacatgcagagacacacataggctcaaaataaaaggatggaggaggactaccaagcaattaaaaaaaaaaa

SEQ ID NO: 17158 - DNA, 230 bp, Homo sapiens
gggggcatgcatggtcattgtggatattggttttgttttggttgagggaacttaggatataagttcactccctctatttttctttgtgattcaagtttttcaaaaatctttttttcttccctttctccccattgtggaaattacaaatcaaaggcctttttctttaatgtaaagtgtatttatttaaaaaaaatacaaaataaactacaagtctgctcaaaaaaaaaaaa

SEQ ID NO: 17159 - DNA, 171 bp, Homo sapiens
aaatcaataaatataaaatataagcacatatttattatatatctaaggtatacaaatctgtctgcggtgaagtttacagattggtgaatatcacctgctcaacatgtaattatttaataaaactttggaacattaaaaaaataaattggaggcttaagggttaaaaaaaaa

SEQ ID NO: 17160 - DNA, 170 bp, Homo sapiens
ttctactcatcctaatggctggatatgtttgcccggagtatcagactaaatcactaagaggggagactgaagatttttaggcatctgtctttctgccagggagaaacccctcggaagaatcttagtcactctttgcacctgccctgtcattctcgccatggggaaaatgc

SEQ ID NO: 17161 - DNA, 510 bp, Homo sapiens
tcaggtgatcctcctacctcagcctcccaagaagctacgactacaagttgtgcaccaccatgcccggctaaagtgttttaaattttttgtagaggcagggtttcaccgtgttgtccaggctggtcttgaattcctgagttcaagcgatctgtccaccttggcctcccaaagtgctgggattacaggtgtgagccaccatgcccagtccagccctaaactaatcttatccagagctggcatagtgcagtgaactaaaggagaactctagatgaatcaaatgagcaggcatgtcttggaaagaaagggaagctggatagaataaaggaattagggaccaaacaagaaggcaatagggaatataactacattctaaatgagaaataaggcaaaatctatatacattctttataaatggatgtccaaagtaaccctagggaggagagcttttttttttcattccatttcatttaaaaatggatccttgattttagaaaacttacaattgggttg

SEQ ID NO: 17162 - DNA, 121 bp, Homo sapiens
gtcattctgaaaggaccttttttgtacttacctaagaggatgcttcaacatatggaacgctacatgttgcatttttcaaacaagaataaactctgcattaaagagatgtagcttgttttaa

SEQ ID NO: 17163 - DNA, 274 bp, Homo sapiens
gcagagggtcatctttgcaggcaagcagcttgaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtagcaaaaaaaaaaaaaa

SEQ ID NO: 17164 - DNA, 339 bp, Homo sapiens
ctgaaaggactttaccatagacaataacatgcagttttatcagcaccaaaggatgttgtccaaaagagactttttaatacctgtctttctatttataacatctgaatattttcattcttatattaagaattttgataagtagattgaatgtagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtgggg

SEQ ID NO: 17165 - DNA, 412 bp, Homo sapiens
gctttgtacctggctaagcaattgtcccattgttgtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaa

SEQ ID NO: 17166 - DNA, 373 bp, Homo sapiens
gtaactttttgccaatattcaaaaattgtattacatgtttatattaataatgtaatatgtaatagagaggccgtttggggagaatgccaaaatatctgaccaaagcaagcatactgtcttttaaaaattatttaacagacgatcgtgtgctggctaaattttctagtgtagacacccattgttggaagcctttgtaataatcctttattaaggttaatgataatattaattccaaaggacatatttcttaaataacaaaaccaaaggctttgtgtctgtctttaagaatgaaggataatgtcctactttatcaatctggatcaataaaatgtagaaacaaatggaaattttagctatatcataataaaaaaaa

SEQ ID NO: 17167 - DNA, 452 bp, Homo sapiens
caggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcccgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccctacaagtaaagacaatgaagaacagtttgaaacatgcaaaatatggagcttttcatgtaattactcttttactgttaccattcactataattcacaattaaaattg

SEQ ID NO: 17168 - DNA, 329 bp, Homo sapiens
aaaaagagtgctgaatttttgctgcacatgtttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaatta

SEQ ID NO: 17169 - DNA, 500 bp, Homo sapiens
ggatggggatcctgcttgggcccccaagaattatattgttgaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggaaattgaatgtctacctgtaagcatgaatctttgaggcagtttatgtattgctgaatagcaatttatacaagaagctgccataactgattatgcctatgacctacttacacatttttaactttatgaccagcctaaatattctgggggaagggg

SEQ ID NO: 17170 - DNA, 608 bp, Homo sapiens
aatgcttcctcattatgagccaattccattcagttcttctatgaatgaatctgctcccactggtattactgggcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggcatgattacctgcatgctttgagctcagcagcagtcttcataaacacatttaaaacaagatcctgggtttttgtgggttgacttctatggtgttttaaaaaaacacagatttttagtggtaatattgtgtaaatgactcaccttaggggatcatttgaatgatgggattatccatgattgtatacagtttgggaaattgttgcaagggcaaagaaactcttaaaaaccgcgagatacaatgctctagaatcgctataagaaaataaatgatatccgc

SEQ ID NO: 17171 - DNA, 383 bp, Homo sapiens
actataaagtcacctcaaacaccaattagcaagtactgaactattactcctataataaatacagggtttggttggtgcaaacctgtcataacatttttatcaattgatcaatatataaccttgttttatgtgtgtttctgtacattcctgtttaaggacaccttatttaaaatacatattgttcattcactaacactgaacacatggacaactgtcctataccttacgcttgactgaagcctatctaatacacaccttttccttttctctgtaagtacatcgtggcttcttgcacttagaaacactagacctcagctcagcactacatcagagggccgttttaaacaacgaaatgatgctgtttaatgattggtctcaaaata

SEQ ID NO: 17172 - DNA, 258 bp, Homo sapiens
aggggctctacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaagcc

SEQ ID NO: 17173 - DNA, 233 bp, Homo sapiens
caacctccctcaccattggcagcctagcattagcaggaatacctttcctcacaggtttctactccaaagaccacatcatcgaaaccgcaaacatatcatatacaaacgcctgagccctatctattactctcatcgctacctccctaacaagcgcctatagcactcgaataattcttctcaccctaacaggtcaacctcgcttccctacccttactaacaaaaaaaaaaaaaaa

SEQ ID NO: 17174 - DNA, 480 bp, Homo sapiens
gaactatgtagcatccaaagaggaaatgagacttttgttgaaggatgagtaacaaaagatgcaaagggaggcatttaaatgtctttgagtagaggcactattttatatagaacacagaggtatgaattgccatggtgtgagtgtagaaaaataatcccacactggggagtcatgtacagggagaccagtttccaggaagagcaacagttcacttaggaggtaatgaaggcctgaattactttaatgtgttcatgtgattattcatagctgagttttctaaaaggtgtagtggagagggcctaatgaaagggaaaacagggaggataaaaagaaaaaggaaatacatttctcccaatatattttgtaaggtaaaaagtgcaaggccatggccaggttcagtggctcatgtgtgtaatcccagtgctttgggaggctgagatagggaggatcacttaaggccgggagttcaagatcagccca

SEQ ID NO: 17175 - DNA, 284 bp, Homo sapiens
caatcaaagactattggctctaccatgaggacaggattacatgactcgaacaaaagggaaaacaagctgatacagatccagagatgatccacatcattcaggtttattagatgaacctattttcagtaacaactatgtcatgaacatagaggacgtatggagaaaattgatgtgaaatgaagaatttcattagcacattggaatggctagaaggattaaatggaaattcaagaagggaataatacagtatctacatttaaaaaactcattagatccctgttatg

SEQ ID NO: 17176 - DNA, 508 bp, Homo sapiens
aaaattaatatcacagcataacttccaccctatacattttgagcagtgactatttgttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcataccgtaaaaatggccacagtgacttatttgtagttgttagttgccctgctacctagtttgttagtgcatttgagcacacattttaattttcctctaattaaaatgtgcagtatttcagtgtcaaatatatttaactatttagagaatgatttccacctttatgttttaatatcctaggc

SEQ ID NO: 17177 - DNA, 266 bp, Homo sapiens
tttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcaaaaaaaaaaaaaaaa

SEQ ID NO: 17178 - DNA, 544 bp, Homo sapiens
actcggtggtggccactgcgcagaccagacttcgctcgttctcgtgcgcctcgcttcgcttttcctccgcagccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgcaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgctttcccatctgtctatctatctggctggcagggaaggaaagaacttgcatgttggtgaaggaagaagtggggtggaagaagtggggtgggacgacagtgaaatctagagtaaaaccaagcctggcccaaggtgtcctgcaggctgtaatgcagtttaatcagagtgcca

SEQ ID NO: 17179 - DNA, 611 bp, Homo sapiens
cggaacggaagtggaagtggccttccaaggcttttttttcgctggcgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctagtagggttttactgggattagtgaaacaactgctatgttctcagcacccactccaaagccaaaggcaaaactaaaattgtaaaatatctcaaaaacaataaaaatggtatttatttatcagaagctctgggatatagcaaaactgtactaaaaataattaaaaaaataatttatctcagccaatgaataaaaaatctaatggatt

SEQ ID NO: 17180 - DNA, 319 bp, Homo sapiens
aaagaagtggtggctgctaaaaaaaaagctacagtgttttttaagggtctttttgatttatgtaaatatttggaaattggtcagtgcctgtaaatttaaatataaaaagtaaccttgaaaacagttttaactttttcaaaagaactatgtccaacattttttagacctgctgtagtacagttttgtacctctaacgtatttttttttgcagaccaaatgctaaaacttttgcttttctttgacttgtaaaaggtgcacattttcattttcttccttaagttcaaatttttgtatgatgtcaaatgcaataaaatttttt

SEQ ID NO: 17181 - DNA, 510 bp, Homo sapiens
ggatctgttgttgttaagtatcccaatttacaaatgaaaatgcaatgtctcagaaattcaaacaactctcccaatgacagaagcaatctatgtattggttagcatttacgtgagttgggtgcacttattagattacaataatttttgtggaactgtttgtccgtcagaatatacttttctgataaaagaagcattggtactttggttgggggatgatcatcttacgcctctgactatgaatgccatggcttctgtttctctcctaggtatcagagaaacttgaagaaaacatggataggctgagagtaagcctgccatttgggatgatgtactgtcaactagagatgagattgagggatggcaaacaactgcgttccacagatggcagaaaacatcagcaacctggataaccacctcagagctgaagaactgcttaaagaatttgaggtaaattgactgtgttgacatatggcagctggggcatattgtgaccagaatatgaaaaaaaaa

SEQ ID NO: 17182 - DNA, 539 bp, Homo sapiens
  misc_feature 234: n = A,T,C or G
gtttagaacttaaatgcaagcttggaaagtctttttcctgtttgaaagagagagaaagagagagaaagaggtgattggaagtggtgggtgggggcggagaaagagaaggagagtaatctgggtgtagacaactcaaagtttgctgagatgactttaatcttttgactctgttattaagatttttaccaaagagcaactgtagctatggtggcctgacttgaagggacagaccanacaaacaacaaaacacaaaacataacaaacaaacaacaaaagcaagagcagaaactattggaaaatgatttattcaccaatattttaaaggttcttcctgttctaagcaaggaacatctttaagttctttataatgtacccattttacatttacaaaaactgccagaagttgacagcatgttttggggggttctaagctatcagttaattttttggggtacagtttattgataactacagagtagaaaaaatctaatggaatcccccaaattaaaagaggccagaaaggagggccattgacccga

SEQ ID NO: 17183 - DNA, 507 bp, Homo sapiens
tgggcaggaatgacacccaccctaccacagggtcagcctccccgaaacaccagaagaagtccaagttacatggccccactgaaacctcaagctgtgcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttaagactttgcgagcagagagtcgtggaatcaaatctgtgctctttcatttgctaactgtatgatgtcacacaagccccttaatcttccatgtctccattttcttctctgggaagtaggtataagaaggcctatctcatatggatgc

SEQ ID NO: 17184 - DNA, 440 bp, Homo sapiens
ctgccttaccatcaaatcaattggccaccaatggtactgaacctacgagtacacgggactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggccgtatttaccctatagcaccccctctaccccctctagagccaaaaaaaaa

SEQ ID NO: 17185 - DNA, 272 bp, Homo sapiens
  misc_feature 1: n = A,T,C or G
ntactagttattatcgaagacatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgcttaatccaagcctacgtttccacacttctagtaagcctctacctgcacgacaacgcgcttaaaaaaaaa

SEQ ID NO: 17186 - DNA, 602 bp, Homo sapiens
  misc_feature 1, 4, 9, 12, 18, 20, 26, 33, 40, 47: n = A,T,C or G
nggnagggnagngtctangngagggntccggcnaatgggnagggacncaaagagattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatcattcaaaattactattgtatacaagcttaattggtaatattccctaacacaattttatgaagggagaagacattggtttggtggcaataacagtacatctttcaagtctcagctattctctcctctcctatcttacattggagatgggacctatggcactatgtggaaggaagctataagcacaagcatccattcccgactgg

SEQ ID NO: 17187 - DNA, 650 bp, Homo sapiens
gtcctgaactctgctacagactaataaaacttcggttaagttgcgagcaaaagggattatttggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaaggtagtcctggagcatttacacctttggtgaagtggaacgacttatctgtccaagaatcaagctgaaggaattgccagaaaaaatgcccaaaactcttcaggagctgcgggcccatgagaatgagatcacccaagtgcgaaaggtaccttcaatggactgaccagaagaatgtcatagaactgggcccaatcccgtgg

SEQ ID NO: 17188 - DNA, 545 bp, Homo sapiens
cactccaccttactacctgacaactttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggcactaggaaaaaaccttgagagagagtaaaaaatttaacacccatagtaggcctaaaagcagccaccaattaagaaagcggtcaagctcaacacccactacctaaaaaatcccc

SEQ ID NO: 17189 - DNA, 101 bp, Homo sapiens
gggccagagtttgcacaaaacagaggggggccatcatcagcagagcccccagacgggtaactaccagagattccacgctctcaggctgactaagagtccgg

SEQ ID NO: 17190 - DNA, 219 bp, Homo sapiens
cacacggctcttttatttatttttttgggcgcctttaacagatcttaattaagtggctttatgccataacttagtgaagctatcaggaactatttaagtgagaaaactctgcctcttgcttgtaaatgagattgctctcacttactcgtaaacataggtattcttttatgggcgcttatcattccttctttcaataaatgtctggttgatcccgaaaaa

SEQ ID NO: 17191 - DNA, 560 bp, Homo sapiens
tgagggaagcaaattaaaaaaacaggatgtaatgttcttctcatacagaaatctattctaagagatgcgcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagtggccctcgattaactggatattcacgaaactgagtggtatggaatcctactgcgtccgtgcttttgcagatgctatgggaggcattccatctaactaccgaaaatgcccgggcctgaattc

SEQ ID NO: 17192 - DNA, 542 bp, Homo sapiens
  misc_feature 404, 407: n = A,T,C or G
atctgtggctagggataagagaggccctggcctcttttacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggttgatctacatgagaagtataagtggctctaccccctgaaagagggtggatgcagctgcttgtgtttcttggggtgactgcattggtaatacggacacagtgacccatcctcatcctatttatagnggnagggcctcaattgtatcaagtacttttttttaagctctgcacattgacctctatgtgttaccaagcattaatgagctgctgcagaaggtgactattggtttacttcttggaaggtaacattacactactccttcc

SEQ ID NO: 17193 - DNA, 289 bp, Homo sapiens
gggctgcccgaggactaagccactatcatctgatttgttagggatgggtactgaatggcagaaattaatcagctcccaatgggagcccacggaactaagtagggtcccaagaaaaaaaacgggagctatttcacagagctgagctactgccaaatttcattcctcaaacctttcaggaggggtggctggccgagctaaaacgattatgggatttgagatgcaaggtgccactcaaccgactagcctggagaagcaaagtcagatcttaactatgaaaaccgacattacc

SEQ ID NO: 17194 - DNA, 572 bp, Homo sapiens
acttctgtggaaattgagcagttgtatcttctttaccaccaacagattttcagcttgccatgataggctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccagcaatcatttaaaataaaccatattaagtttagtatgctggtattgtttattcattttatatgaatatcattgaaaatatatcacaatatatgtaatacacagccttgatacaaaatgtaattaattatattattgctggcagcattcagttagagggtctttaaaaaaaagaag

SEQ ID NO: 17195 - DNA, 308 bp, Homo sapiens
gcaggagaatctcttgaaccttggaggcataggttgctgtgagccgagattgcaccattgcactccagcttcggggacaagagcaagactttgtttcaaaaaaaccaaaccaaaccaaaccaaaacaaacaagaaaacaatagggcaatctccataatgaatacaggtgaaaaaaccctcaacaaactattagcaaaccaaattcaggagcacataaaaagagtcatttaccatgatcattgggatttatccccaggatggaaggatggcccaacatatgcaaatcaataaatgtgatacatcacagt

SEQ ID NO: 17196 - DNA, 416 bp, Homo sapiens
tttgaatctctggctatatgcatgacatatttctaagtttatttaggtgtttaaaaaataccactgaataaacttatcttctccataaaggccatttgcctcttttgtcagagtttcataatttagaggaaatggacaaattcctagaaagacatcaactaccaagactaacttgagaaattgaaaatctgaatagacctataacaagtaaagagattgaattagcaatcaaaacactaccaacaatgaaaagcccagacctagatggcctcataggtgaattctaccaagcatttaaataagaattaattattcacagcctgttccatagaaaaaagagagaacacttccagatgaattctgtgaggccggtttaccctcattctaaaaccggacaaagatatggctcacatgag

SEQ ID NO: 17197 - DNA, 590 bp, Homo sapiens
aaaaaatagtatctcactgttttaatttgcatttattttgattacaaatgaagttgatagttcttcatatggctaattatgtgtttcctacagcatatataacttaactaaatatctctgtgaaattacttgatttctttggctgccctaaatagagcaaaacattatggagtaaagctttttggaaaggaagtctagcaaataatcggaggtgtagacatagttgagaaggcttgtggagtggggaaatgtttgtagggtgagaatatgcagatgtgaaaggataacattcgcatctccctgaactgccctgtaaaacactacgtgtctgttgtgaaatacatggcatgacttgcacatagaggccaataaccctcagttccccttcctcaaaaaacattccccagaggtaaaaaggttatagtggtgaccccaatttatcaagaagcactttataaaggtcagtggtttctggctaaaaaggtggagatacatgctgccaactgtcaaaagcatttttaaatgaacatatatacttaatacaggaaaatattttaggaaaatattcctaatcagaatttccttccaag

SEQ ID NO: 17198 - DNA, 620 bp, Homo sapiens
gggctggtgggaaggaagaatgtcgagtaactgtttaatttgtacgggattttattttggcgtgatgaaaatgtttttgaaccagatagaggtggtggttgtacgatattgtgaaggtactaaatgccgctgaattgttcactttaaaatggttaattttatgttatgtgaatttcacctaaattttaaaaaatgtgtaaaaggattttaatggacgtttttccaaggaagatatacaagtggtcaataaacacgtgaaaaattgccccaaatcattagtctttagggaaatgcaaataaaaaccacaatgagacattacttcccacacactactacccaatgtcatctacagatccagtgtaatccctatcaaaattccaataacatttttcacagagatagaaataaaatcataaaattcatatgaaactacaaaagttcctgaatagccaagaaagaaacaattttaatatagtgtagcctaagtgttcagtggtataaaggttccagtagtgtacagtaatatcttatgccttaacattccctcccactcctcaatgctccccagagcacttccagtcctgcaactccttcatggtaaggtgccctatacaggtgt

SEQ ID NO: 17199 - DNA, 519 bp, Homo sapiens
caactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggccagtgttctgatttgggtctggacaaagtgccaaaggatcttccccctgacacatctctgctagacctgcaaaacaacaaaataaccgaaatcaaagatggagactttaagaacctgaagaaccttcacgcattgattcttgcaacaataaaattaagcaaagttagtcctggagcatttacacctttggtgaagtgggaacgactttatctgtccaagaatcagctgaaggaattgccagaaaaaatgcccaaaactcttcaggagctgcgtgccc

SEQ ID NO: 17200 - DNA, 373 bp, Homo sapiens
  misc_feature 373: n = A,T,C or G
aacacccgtggagcccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttn

SEQ ID NO: 17201 - DNA, 592 bp, Homo sapiens
agattcatattctcaagtgtgctcaaatggatctgtgtttgggaaagatatgtgaaataagaaaataaaagctaatccatttgttttaaaattttgtctgcctaccacattttgttggacttcttgttatatgagaactcctaattgtctggttttcaattgcagccaaaagcattcttacctgatcaaactcttcaaattctatttactttgaattatagctgagtcatggaaagtataattgggccttactttggtacacagcagacaaaacatatgctcaagataggcagtgctattccagtgaataaacattttaacaaaaatttgtatgagaaattcatgttggcctctcattcctctctatatgcctttcacagttactctttttccccttgcaatcaaaacactataatgaatatctcttggccttaacgataagaaacactgtatataaatattgtctaggctggattttatgagaatgtggaggtatatgaaatggaggaggaaaaaatatgggggaggaatcccgggagcaggggacgggctgacctctaggaccctggtaagcatcagtgtaggtacacct

SEQ ID NO: 17202 - DNA, 614 bp, Homo sapiens
caaaataaatctctccaattctaaactgaaatattaacatcttcgtggcttagcacagtttatagtgtgtttcacattgaatattatttttattatcagaagagggaaagctacatttaaatgatttttttagttggggaagagtgagtggagaatacctatggatgggtctttatataaaacactgaaacattctattaaccagatgttaaccagtgataatggtagaaagagaacaatgcaacaaaaaccttatgctggagccaggagacaacattgtaacacaattatttacttaaattaatctttttataaatgataaaggtttaatattcatagagctcttataaatctgtaagaaaaagaggaataccttattcacagatggatcaaaagaaataaggccattcacaacagaaaatatacacaaatggccaatatatttttaaagaatcaaagtcagtggtcataaaaatattaaaacagaaaaatatttttcttcacatataaggttaccaaggttaagaagaattagaaaatcttattttagaaatagtcctcttgctgggcacggtggctcacgcctgtaatcccaccctttgggaggtggaggc

SEQ ID NO: 17203 - DNA, 582 bp, Homo sapiens
ggaaataaactcaagctgatgcttcaaaaacgagaagcttctgttccaactaagactaaagtggccgttggggagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcaagcaagatcttttctacctactttgtgtgatcaaaaaagaagaagttaaaacaacacatgtaaatgccttttgatatttcatgggaatgcctctcatttaaaaatagaaataaagcattttgtaaaa

SEQ ID NO: 17204 - DNA, 470 bp, Homo sapiens
tatttaggaaagctttccaaatggaagaaatgttattctctgataaagagctaatacagaaatgttcaagtgattttactctctggtaatgccttcagtaaaatattttctctatctaagtattaacattctaagtctaccagaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtgggccagtgcacactaccttccacccatacacatccatgttcactgtaacagactgaatattcacaataaagcttctgagtaacactgtctgattactcatgataaccgacatggctaactgcgagaa

SEQ ID NO: 17205 - DNA, 310 bp, Homo sapiens
gcactgttgcagtcattctgaaaggacctttctttgtacttacctttcaacatgcttcaatcttatcaacgctacattttgtatttttcaaacaagtataaattctgcaataaagagatgtagttttttttaagattgagtttttgtttgttatttctgaatggttcatcagtatgttaactataccttttatcgagaaggaaaatcactaagttttattcaggctctaccaacccccattatatctactgtttgtttatgtcctaaattaacctttcatcctatgaagtaataaagttcattttaaacc

SEQ ID NO: 17206 - DNA, 305 bp, Homo sapiens
acataaagccatttaccgtacatagcacattacaggaaaatttccttctcgtgcccatggatgacccccctcagataggggtcccttgaccaccatcctcgggaaatcaatatccgccaaagaaggctactctcttggtccgggccataacactggggggagctaaagggaaccggatcgaatctggtcctactttagggccataaaggcaaatagcccacggtcccctaaaataagacatccgatggatcacaggtctatcaccctattaaccactcacgggagctctccatgcattcgcaaaa

SEQ ID NO: 17207 - DNA, 307 bp, Homo sapiens
ctattgacgtgctctcacttaccacatatacctatttcggctacatagttgcaaagaatacgagagggtgctgaagaggagagccaagatacatcaactgcgtctccatctaatacccgcagtagagacgcatgcatcatacctgaaaagtgaataacttgaacaataataggagcacttcatattttacctgtatatatgaaccatatgatatgacagctatggcaaaagctagccccaaacgggggccattacatgatgctaataaattaattcataaataagcaaacaaaaaaaaaaaaaaaaa

SEQ ID NO: 17208 - DNA, 650 bp, Homo sapiens
aaactccaaactccaaactagttgaagtaaatccaaagagtgaagatgcaggtggtgctgaaggagaaacacctcatatgcttctcaggccccatgtgttcatgcctgaagttactcccgacatggattgcttaccgagagtacccagtcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggatctcaagtactggcgtttaccaatgatataaaagatgcagggtaccccaaaccaattttcaaaggatttggaggactaactggcaaatagtggcagcgctttcaacagctaaatataagaactggcctgaatctgggtatttttcaagagaggtggcagcattcagcagtatattataaacaggacctgtacagaagtgccctggaagaaggcctgctctaaatatccaggtatggagaaacgacacaggtta

SEQ ID NO: 17209 - DNA, 118 bp, Homo sapiens
ggagaaattaattatctatgaaactcaaataaatttgaattaatacaactgaagcaatgaaggatattagctcaaagcttcatgtgggttgcaaaattctgccttaaaaaaaaaaaaa

SEQ ID NO: 17210 - DNA, 147 bp, Homo sapiens
aaaaattgtattgaaaactcttagtatgcacgtcagattagaggaatttggtataattatggtgggtggttattttttatactgaatgtgccaaagctttactactgtggaaagacaactgttttaataaaagatttacattccaca

SEQ ID NO: 17211 - DNA, 219 bp, Homo sapiens
ggttctaaaacatgacggaggatgagatgaagcctcctcatggagtaaaaaatgtacttaaaagaaaattgagagaaaggactacagagccccgaattaataccaatagaagggcaacgcttttagattaaaatgaaggggacttaaacagcttaaagttaagtttaaaagttggaggtgattaaaataatttgaaggcgaagaaaagaatagagaaga

SEQ ID NO: 17212 - DNA, 400 bp, Homo sapiens
tggagagctaaagtccaagagaggatccgagaacgctttaagcctgtccacgagctcaatagggaagcttgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggcaaaggagagcaacatatgtgattgttccataataaacttctggtg

SEQ ID NO: 17213 - DNA, 118 bp, Homo sapiens
taggagcaacagctaaataagggagaatgaattatgcagcttttgtggaaaagacagaggaaatccagaatattctgagactatctattggacagcaaaatgggggtttgcagaagat

SEQ ID NO: 17214 - DNA, 414 bp, Homo sapiens
  misc_feature 351: n = A,T,C or G
tttcttggccttggaggctatccagccgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaccatgtgactttgccacagcccaagatagttaagtgggatcgagacatgtaagcagcatcatggaggtttgaagatgccgcatntggattggatgaattccaaattctgctgcttgctttttaatattgatatgcttatacacttac

SEQ ID NO: 17215 - DNA, 287 bp, Homo sapiens
gaaacgaaaggcatgacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactaggtagtgcagcttttcatt

SEQ ID NO: 17216 - DNA, 166 bp, Homo sapiens
agtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaa

SEQ ID NO: 17217 - DNA, 104 bp, Homo sapiens
  misc_feature 80: n = A,T,C or G
aacgactccctctacgttttattttaaaatagaaaattctgatgggaatctgcaatataagccaagatatgtagtaaganctcacatactttctcagatttggc

SEQ ID NO: 17218 - DNA, 381 bp, Homo sapiens
  misc_feature 66, 67, 157, 336, 349: n = A,T,C or G
aggccactaagttggtaggtgctttttgtacaaaagcccaggagaatatgatctgtaaattctagnngagtgatgaagatggggctttgaattaatctacagtcttggaattaattctgcagcattttaaccagggaatttttcagtagtcataaanctatattttaatactgagtaaatgtcctcatttacccccaccaattttgtaaagcagatattaaccaaacttcaatagttataagacaaaaatttaatgaaaattggcagtatgtataatccagggctaaatagtacattggctggagtagaaatttaaaatacaatagatgctggagnaaatgtacatatnatcatcatctgatcatcttcttcctcagagat

SEQ ID NO: 17219 - DNA, 127 bp, Homo sapiens
tacacctgtagttatcagcattttgggaggacgaggcgggcagatcacctgaggacagggatttgagaccagcctggccaacatggtgaaaccccgtctctactaaaaaatacaaaaattagccggg

SEQ ID NO: 17220 - DNA, 137 bp, Homo sapiens
gcccacatgttgcccatgagggctgaggagactgttcagagactgcccagccctagggcactgtgccaccctcattcctccagagcttgacccctggacatttgcactgactttatccagaccaaagagctgcctct

SEQ ID NO: 17221 - DNA, 306 bp, Homo sapiens
  misc_feature 128, 133: n = A,T,C or G
cacatatgttaacatcagttggatctcctatagaagtttctgctgctctctttcctcctccctgagctggtaactgcaatgccaacttcctgggcctttctgactagtatcacacttctaataaaatncacanttaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcata

SEQ ID NO: 17222 - DNA, 149 bp, Homo sapiens
  misc_feature 90: n = A,T,C or G
aagtggtcagcgcatcctgcagggcttctcctcctctgtcttttggagaaccagggctcttctcaggggctctagggactgccaggctgnttcagccaggaaggccaaaatcaagagtgagatgtagaaagttgtaaaatagaaaaagt

SEQ ID NO: 17223 - DNA, 133 bp, Homo sapiens
  misc_feature 90, 101: n = A,T,C or G
gagactaaaacttttaaaacttatttctaaccaatagaaatgaatatgcatatatatatcatatatacatggcaaaaatgataaggtganagaaggtcagntctgtgattacattaccttacataaggtaagg

SEQ ID NO: 17224 - DNA, 101 bp, Homo sapiens
ctatactaaccccagggttggtcaatttcgtgccagccaccgcggtcacacgattaacccaagtcaatagaagccggcgtaaagagtgttttagatcaccc

SEQ ID NO: 17225 - DNA, 184 bp, Homo sapiens
  misc_feature 162: n = A,T,C or G
ataacaagaaaaaaatttaagtttaaatgtttacattgcgttactaaattaataccaattcaaattaagtgacctatagtaaattaatggcaatgggggggaggggattttaaagtgattggcatattatgtgatactgtatcagtgatttagtgaaataanatgtatcatagcacaactctgt

SEQ ID NO: 17226 - DNA, 455 bp, Homo sapiens
  misc_feature 34, 119: n = A,T,C or G
ggatttgccatcataggaggcttcattcactganttcccctattctcaggctacaccctagaccaaacctacgccaaaatccatttcactatcatattcatcggcgtaaatctaacttncttcccacaacactttctcggcctatccggaatgccccgacgttactcggactaccccgatgcatacaccacatgaaatatcctatcatctgtaggctcattcatttctctaacagcagtaatattaataattttcatgatttgagaagccttcgcttcgaagcgaaaagcctaatagtagaagaaccctccataaacctggagtgactatatggatgccccccaccctaccacacattcgaagaacccgtatacataaaatctagacaaaaaaggaaggaatcgaaccccccaaagctggttcaagccaaccccatggcctccatgacttttcat

SEQ ID NO: 17227 - DNA, 182 bp, Homo sapiens
tgaaaactgctgaaagaaagaaaacctgttagaattctacatctaacaactgtcctttagaaatgaggaagaaattaataccttcccagataaaagctgagggagttcattatcattctttgcaagaaatgctagaaggagtctttcaggttgaaacgctgaacactataaactttttaaaa

SEQ ID NO: 17228 - DNA, 323 bp, Homo sapiens
gaaaggcttatgattccaatattagaaatatgaaaattgaggtagagagaagtaaaattttctcaaattcacacaaaatggagaagtaaagccaagagtagaacccaactcatgtggaatagatctaatgcaaaatacaatgtcaagcttgcaaaggtaattaaactcagtagcgtaattacctaaattatagtacaggaaaatagtgtcatatttacaaacctaattatatcaagtgggagaattacctgaatgataggtaatcatatggatggcgtccacatactctatatgcttttttttattccaaatgcttaaaaata

SEQ ID NO: 17229 - DNA, 335 bp, Homo sapiens
  misc_feature 99, 120, 128, 250, 277: n = A,T,C or G
gatgtagacttaagctttatccctactaggcttgctccactttcatcctccactatagatacaacggactttgactaaaagcagtgaaggggatttgcntccttgttatgtaaagtttcncggtgtgntctgttaatgtaagacgatgaacagttgtgtatagtgttttaccctcttctttttcttggaactcctcaacacgtatggagggatttttcagggttcagcatgaacatgggcttcttgctgnctggctctctctcagtacagtcaaggngagcaagggacccacacagatagcatcaacaaaagctgcctcaactttttcgagaaaa

SEQ ID NO: 17230 - DNA, 160 bp, Homo sapiens
  misc_feature 141: n = A,T,C or G
tgaccaactcatactaagtgcttagtaaatgttagataagtattctccagaattgatgtaaattatttttaaacagtgcattcttgaaagcagtatggcagtcataaaaattttggaaccaaaacagtatctttttttaangctaaaaaaaagttttaaa

SEQ ID NO: 17231 - DNA, 149 bp, Homo sapiens
ttaataggaagtaatgtctcacccaagagaaatgaagagcagggaagagtgactttctccttctccctccctctcccctggatatggaactcaaccattatgcactgcttcttttgtgtgggttgctgctttttggacttcttggaatt

SEQ ID NO: 17232 - DNA, 355 bp, Homo sapiens
  misc_feature 135, 191, 299, 333: n = A,T,C or G
tacagcctctaacaaaactaggctgtcccgaacccctggtaatagaattgtttacctttataccaagaaggttgggaaagcaccaaaatctgcatgtggtgtgtgcccaggcagacttcgaggggttcgtgctgnaagacctaaagttcttatgagattgtccaaaacaaagaaacatgtcagtagggccnatggtggtccatgtgtgctaaatgtgttcgtgacaggatcaagcgtgctttccttatcgaggagcagaaaatcgtgtgaaagtgttgaaggcacaagcacagagtcangaaagctaaataaaaaaatgaaacttttttgagnaataaaaatgaaaagacgctgg

SEQ ID NO: 17233 - DNA, 185 bp, Homo sapiens
  misc_feature 14: n = A,T,C or G
gatagtaaacctgnacggtgaagtgattggaattaacactttgaaagtgacagctggaatctcctttgcaatcccatctgataagattaaaaagttcctcacggagtcccatgaccgacaggccaaaggaaaagccatcaccaagaagaagtattattgggtatcccgaatgatgtcactcacgt

SEQ ID NO: 17234 - DNA, 202 bp, Homo sapiens
  misc_feature 39, 46, 51, 75, 108, 114, 123, 154, 182: n = A,T,C or G
atgtttctctttgaaagatagagattaatacaactactnaaaaaanatagncaataggttactaagatattgctnagcgttaagtttttaacgtaattttaatagctnaagacnttaagaganaatatgaagacttagaagagtagcatgaggnaggaaaagataaaaggtttcaaaaacangacggaggttgagatgaagc

SEQ ID NO: 17235 - DNA, 239 bp, Homo sapiens
  misc_feature 24, 71, 73, 82, 99, 156, 158, 225: n = A,T,C or G
gacactggtatctttgattgcggnggtgtaatacaatgggataagaactatatgacgcattttctatcagnancaagttccncattttaatattgtacnacagtcatataagatgtagccattgggggaaactgtgaagaaaggtacagaagaccncnctgtattatccttgcaattacaggtaaatatataattatttcacaataaaggtttctaaatgatganaaaaagttaaattc

SEQ ID NO: 17236 - DNA, 159 bp, Homo sapiens
  misc_feature 35: n = A,T,C or G
tgcaaaattacccacttttttcctttgtttccagnctctacccccctaacttcatcccctgtccaaaatattatgctaatcctaatcagtggaaagcagttttattaatttatttaaaatatttgaatggatggtaattacttgatgttacaaaaatag

SEQ ID NO: 17237 - DNA, 168 bp, Homo sapiens
  misc_feature 37, 46, 69, 72, 91: n = A,T,C or G
tgtattaaagcaactcgatgcccagcagacacagctncgaattgantccttctttagattagcacaacnggngaaagaagatgctaaacgnattaagagccagagactaaacagagctgtgacatgtatgctaaggaaagagaaagaagcagcagccagcgaaataga

SEQ ID NO: 17238 - DNA, 296 bp, Homo sapiens
  misc_feature 5, 40, 112, 227, 253: n = A,T,C or G
acacnggggggaagtaggtcctggaagtaggtcctggggnggacaggacaaaaggaacaactgcaggtgaggagcacctggattcatatcctggctcctctacttagtggcnaggcatcctggggcaaatctctactctctgagcctcagtttcttcctctataaaatggggatgctagtggtacctgcttcccagaagtgttatcatgattaaatgacagatcggnggcagtagcatctcctgagagagggntagaaatgcatattctcaggcaccactgctgtcttgctgaatc

SEQ ID NO: 17239 - DNA, 151 bp, Homo sapiens
gaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaacc

SEQ ID NO: 17240 - DNA, 162 bp, Homo sapiens
  misc_feature 51, 57, 70, 134, 135, 136, 155: n = A,T,C or G
ccttcagaaggaaaggagaatgttttgtggaccactttggttttctttttngcgtgnggcagttttaagntattagtttttaaaatcagtactttttaatggaaacaacttgaccaaaaatttgtcacagaatnnngagacccattaaaaaagcnaaatgag

SEQ ID NO: 17241 - DNA, 142 bp, Homo sapiens
  misc_feature 30: n = A,T,C or G
aactctttagcaataaacgaaagtttaacntaagctatactaaccccagggttggtcaatttcgtgccagccaccgcggtcacacgattaacccaagtcaatagaagccggcgtaaagagtgttttagatcaccccctcccc

SEQ ID NO: 17242 - DNA, 125 bp, Homo sapiens
aacttggtggcccctgtagagatgccaggtttcttttttatctagaaatggctgcaagtggaagctgataatatataggcaccttgtaaattcatattgagtaaatgaatgaaattgtgatttcc

SEQ ID NO: 17243 - DNA, 437 bp, Homo sapiens
  misc_feature 377, 392, 411: n = A,T,C or G
gtaaaaacaatagggcaatttatctgatgaatatggatgcaaaaatcctcaacaaaataactagcaaaccaaattcagcaatactttaaaaagatcattcatcctgtccaagtgggatttatcccagggatgcaaagatggttcaacaaactcaaatcaatgtgatgcatcatatcaacaaaatgaagaaaagccatatgatcatttcaattgatgctgaaaaaacatttgataaagttcagcatctcttcatgtcaaaaaccctcgaaaaaactggctgtagaaggaatatcctcaacataataaaagctatatatcccacagctattattgtgctgaatagggaaaaagaaaagaaggatgtcactttcaccagngttattcaacatagnactggaagtcttagctggngtaatcataaaagagaaggaaataaa

SEQ ID NO: 17244 - DNA, 287 bp, Homo sapiens
  misc_feature 31, 62, 65, 121, 254: n = A,T,C or G
gtgaagggagagaagtggatttgggagacanaaaggagatggcaccaaaagcgaaggaagcnccngctcatcctaaagccgaagccaaagcgaaggctttaaaggccaagaaggcagtgtngaaaggtgtccgcagccacacgcaaaaaagaagatccgcatgtcactcaccttcaggcggccaagacactgcgactccggaggcagcccagatatcctcggaagagccccccaggagaaacaagctggccacnatgctatcatcaagtttccgctgccactgagtc

SEQ ID NO: 17245 - DNA, 200 bp, Homo sapiens
aagaaatatatatatatattatatatattcttagttctaagatttcctttaattctatgattctctggatttaaatgcattattcatatttcttgaagcttagatacagtctaattcatagcaaccatatctgctttatcctaggtgagggtaagcagtccacaatggaatagaagaaaatcccattataacaaaatgac

SEQ ID NO: 17246 - DNA, 320 bp, Homo sapiens
  misc_feature 242, 295: n = A,T,C or G
gcacacggaaagaactctgtttaaatgctcagttcagaacactttgggccacatagtgattttggaaaacaggataatccgtggtgtaaatgagtgtttcctttcaaagtccactgcagagcttttatccatatggtatgcacatgtagccaatattggttctttttcttaatatatatatattttattttaaaacaacaaaaagggagggcgttgacaccattccccacagagatagtcangctgagtgtgggttgtttaaacatgcatattgaaataacacatatagtaacgngggaatactaaaaaataaccaagaa

SEQ ID NO: 17247 - DNA, 172 bp, Homo sapiens
gatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtg

SEQ ID NO: 17248 - DNA, 167 bp, Homo sapiens
aaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcc

SEQ ID NO: 17249 - DNA, 122 bp, Homo sapiens
tttctggcctggaggctatccagcgtactccaaagattcaggtttactcacgtcatccagcagagaatggaaagtcaaatttcctgaattgctatgtgtctgggtttcatccatccgacagt

SEQ ID NO: 17250 - DNA, 218 bp, Homo sapiens
  misc_feature 126: n = A,T,C or G
tgtcagctttaacagtagaattttacttgggcaatatttgcccattctggtgtaacttatgtgactctagtgcttaacagctgccgttgaagctaatattcagttctgtagagttagaataccttntgttgttgaagatgtgaatgaagtatgcatgtgcattaactgttgaattcacttttgtgccatttttgtaaatacagtagttttgcacaacc

SEQ ID NO: 17251 - DNA, 148 bp, Homo sapiens
  misc_feature 67, 132: n = A,T,C or G
tcaggaagcccgcgcgcaacagccatggcttttaaggataccggaaaaacacccgtggagccggagntggcaattcaccgaattcgaatcaccctaacaagccgcaacgtaaaatccttggaaaaggtgtgntgctgacttgataaga

SEQ ID NO: 17252 - DNA, 172 bp, Homo sapiens
  misc_feature 112, 126, 129: n = A,T,C or G
tgcatttgaacttactttctaaagactgaaaggaccgaaagtaagaacaaaaattacctgaaaagtatttttttcctacataaaacccaggtccttattaatgtttaaatgnccctggtttttgtntgnaagataaagagtatggaaaagattcatgtaaaatcataccaaa

SEQ ID NO: 17253 - DNA, 440 bp, Homo sapiens
  misc_feature 389, 425, 428: n = A,T,C or G
gtgatatcctagtttatatttaaaaaatgaagacaaagtcctgctaatttttgtgtttcgggcaatatctaaatgcaataactaataactaatgtcattcctaaatgcaatacatatagaggtcaaggttataatcacaaattatggaaggagtgtatcatcctgatgctatatgctgttggataccaaaggtaattcaaagtcatattagaatataatctggaaaaagactagagtcaatcgttattatatagtaaagaaagtacaatgtatttgtgtaaataaatgcaacacttttagtaagtatagattagatagttttttccaaaatattttattgcactgatgatgtgccttaaaatttatgcatcttcaaatcaaggaaccanggctcatcataagtaacccggctgcagtatgaaggnggnggaaaacccatc

SEQ ID NO: 17254 - DNA, 172 bp, Homo sapiens
  misc_feature 26, 49, 91, 136, 137: n = A,T,C or G
acatgaccccaagtgcctggatgggncccaaacctgaaggcttacatgngccgttttgaggctttggagaaaatcgctgcctacttacagnctgatcagttctgcaagacgcccatcaacaacaagatggcccagnncggcaacaagcctgtatgctgagcaggaggcagac

SEQ ID NO: 17255 - DNA, 443 bp, Homo sapiens
gagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgcctataacaagcttaaaaacataccaactgtcaatgaaaaccttgaaaactattacctggaggcaatcaacttgagaagtttgacataaagagcttctgcaagatcctggggccattatcctactccaagatcaagtatttgcgtttggatggcaatcgcatctcagaaccagcttccaccggatatgatgaatgctacgggtgctaacgaagtcactcttaattaatatct

SEQ ID NO: 17256 - DNA, 163 bp, Homo sapiens
  misc_feature 10, 12, 16, 18, 20, 89, 90: n = A,T,C or G
acatgttttntntttnananatagagattaatacaactacttaaaaaatatagtcaataggttactaagatattgcttagccgttaagnntttaaccgtaattttaatagcttaagattttaagagaaaatatgaagacttaagaagagtagcatgaggaagg

SEQ ID NO: 17257 - DNA, 488 bp, Homo sapiens
  misc_feature 402, 442: n = A,T,C or G
ttaatctgttacaactctcttgcaaggttccctggttgtgaaaatacatgagataaatcatgaaggccactatcatcctccttctgcttgcgcaagtttcctgggctggaccgtttcaacagagaggcttatttgactttatgctagaagatgaggcttctgggataggcccagaagttcctgatgaccgcgacttcgagccctccctaggcccagtgtgccccttcgctgtcaatgccatcttcgagtggtccagtgttctgatttgggtctggacaaagtgccaaaggatcttcccccagacacaactctgctagacctgcaaaacaacaaaataaccgaaattaaagatggggctttaagaacctgaagaaccttcacgcattgattcttgcaacaatnaaattagcaaaggtagtcctggagcatttacacctttggngaaggtggacgactttatctgtccaagaatcagctgaaggaatgcc

SEQ ID NO: 17258 - DNA, 315 bp, Homo sapiens
  misc_feature 248, 249, 296: n = A,T,C or G
agcctgatccttcttgccatcctggccgccttagcggaagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctggtgatgactacagactttgcgaacgctacgccatgnnttatggatacaatgctgctataatcgctacttcaggaagcgccgagngaccaaatgagactgaggg

SEQ ID NO: 17259 - DNA, 319 bp, Homo sapiens
  misc_feature 53, 204, 229, 242: n = A,T,C or G
tgaggaaaaataactaaacatgggcaaaggagatcctaagaagccgagagcanaatgtcatcatatgcattttttgtgcaaacttgtcgggaggagcataagaagaagcacccagatgcttcagtcaacttctcagagttttctaagaagtgctcagagagggggaagaccatgtctgctaaagagaaaggaaaatttgaaganatggcaaaagcggacaaggcccgtnatgaaagagaaangaaaacctatatccctcccaaaggggagacaaaaaagaagttcaaggatcccaatgcacccaagaggcctccttcgg

SEQ ID NO: 17260 - DNA, 210 bp, Homo sapiens
  misc_feature 7, 130: n = A,T,C or G
agacacnatggcctggggccatgtatggcgattatggatacccataccagcagtatcatgactacagcgatgatgggtgggtgaatttgaaccggcaaggcttcagctaccagtgtccccaggggcaggngatagtggccgtgaggagcatcttcagcaagaaggaaggttctgacagacaatggaactacgcctgcatgcccacaccac

SEQ ID NO: 17261 - DNA, 235 bp, Homo sapiens
  misc_feature 60, 64, 81, 217: n = A,T,C or G
accaaaaagttattttctcaaatccctaaatttctgatttccattcaagtcttttaaacncttncctgctgaatagcaaanaacttttattttccactttcctatattcctaaaaagtgtgaacaatgcgtttcagttgactgtattgcatacttttttgctgaagactttttctgtaaacacaattgccttgttcagttttgttgtaaactgactnaccataagagcactgttg

SEQ ID NO: 17262 - DNA, 146 bp, Homo sapiens
aatgcctgaaaaagaaccaccacctccttacttacctgcctgaagaaattctgcctttgacaataaatcctataccagctttttgtttgtttatgttacagaatgctgcaattcagggctcttcaaacttgtttgatataaaataa

SEQ ID NO: 17263 - DNA, 144 bp, Homo sapiens
  misc_feature 38, 51: n = A,T,C or G
attttgcagaatcctcaccaccctgccaccatgccagngctatataacggnacttaacttggatatgggatggattggagtgaggaagagggaatggttaggagatgtcacagttcaagtacaaagcaattgattaggcaacag

SEQ ID NO: 17264 - DNA, 144 bp, Homo sapiens
  misc_feature 123: n = A,T,C or G
ataataatgtcattagtttctccatttttattttctgaactgtacattcacaacttatgtttccttgagattaatagatattgggggaaaaacgcctttttaggaaaattatagtgaaaattngacagttgattggcataattt

SEQ ID NO: 17265 - DNA, 427 bp, Homo sapiens
  misc_feature 377: n = A,T,C or G
tttcttggccttggaggctatccagccgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaagcagcatcatggaggtttgaagatgccgcatttggattggatgaattccaaatctgcntgcttgctttttaatattgatatgcttatcacttacacttatgcacaaaa

SEQ ID NO: 17266 - DNA, 410 bp, Homo sapiens
  misc_feature 346: n = A,T,C or G
ggacacctacagttacttggcttaacccttctggaagggtctgactgtgtgacccgcagcaaatagttcatgttggaaagaatgaaaacaactcaagttcatagcagccagcctgccgcattggacctcccttttaaaaactgagaccaagactcccatcagctggtctcggatttacatcggaactgctcaggattgatacatttcaagtctgtaaatacggacaccaacgccatttaccctaatttaagaacagcggggactgccctccgtgccgagggctgcatgctaccgcactaagtcaatacatgggctcccgatcgcagctgcgcttggcagcacttgncacgttggcagcacttttgagagcaagtctgagtggacccacatgtaacctgctatgaaaacca

SEQ ID NO: 17267 - DNA, 104 bp, Homo sapiens
  misc_feature 32, 33: n = A,T,C or G
gcaactgttgctacagctgtggagcagtatgnnccctctgagaagctgagtatctatggtgacttggagtttatgaatgaacaaaagctaaacagatatccagc

SEQ ID NO: 17268 - DNA, 132 bp, Homo sapiens
  misc_feature 98: n = A,T,C or G
agtacagtattcttgggactctggctactaattatttgttccattgcaagacaactttttacttaatttcccgattaccattcaacatcgctttccgngagatatagtctacttcaagttagatgcattacc

SEQ ID NO: 17269 - DNA, 155 bp, Homo sapiens
  misc_feature 32: n = A,T,C or G
acagcttctcaagtctaaccagcctcagcagngtgcatagaccatttccaggagggtctgtccccagatgctctgctcccgttccaaaacccgctcatcctcagcttgcacaaactggttgaacggcaggaatgaaaaataaagagagatggctt

SEQ ID NO: 17270 - DNA, 178 bp, Homo sapiens
cccgagagtaaatcatctttccaatccagaggaacaagcatgtctctctgccaagatccatctaaactggagtgatgttagcagacccagcttagagttcttctttctttcttaagccctttgctctgggggaagttctccagcttcagctcaactcacagcttctccaagcatcacc

SEQ ID NO: 17271 - DNA, 183 bp, Homo sapiens
  misc_feature 143: n = A,T,C or G
acttcagggattacataaacctgtgtaccatgcactgagtgactgtggggatcatgttgttataatgaacacaagacacattgcattttctggaaacaaatgggaacaaaaagtatactcttcgcatactggctacccaaggnggatttagacaagtaacagctgctcagctccacctgaggg

SEQ ID NO: 17272 - DNA, 498 bp, Homo sapiens
  misc_feature 302, 317, 320, 360, 479: n = A,T,C or G
tgaccacttaatttacaaactctagatggcaaaagtcaaactgggaaagggaaaaaagaaaacacttataacacatgacagagaaatgggtcattgccttaatataaaggaactcacaaatcagtaacaaaaagttcaaaagcctaaaacggaaaattgacatcaataggttcttaagagaaatacataagaattagaggccaggaaaatatgctcaatctcacttacaattaaagaaatgcaaaccacattatcatgtgtcaccaactagacagacaaagatgaaaaagtcggctaacagngttggcaaaggacgnggnaataaggtctccacaccccactggttagagcagaagggcncagcctcttcaggagaactggcaatagctatggaagcttaaagcaaaagctttgagccagctgctcatttctagaaatggtcggcaacaaacacacaggtgtaggtagaaggatgtcantcccagaaaaattaggata

SEQ ID NO: 17273 - DNA, 107 bp, Homo sapiens
  misc_feature 70, 80, 81, 82: n = A,T,C or G
tagagattaatacaactacttaaaaaatatagtcaataggttactaagatattgcttagcgttaagtttntaacgtaatnnnaatagcttaagattttaagagaaaa

SEQ ID NO: 17274 - DNA, 168 bp, Homo sapiens
ccaaattaaaggaatcggttgggctagttaactgcaacaagagcatgtcctcaaggcacagatcgctcatgctattgtttgtggcttaagaatgcctttaagacgttttctgccctgggcaggccaaggttgttccttgccctcattccggtaaacccacaaccttct

SEQ ID NO: 17275 - DNA, 323 bp, Homo sapiens
  misc_feature 297: n = A,T,C or G
gaatctcgctctgttgcctgggctggagtgcagtggcactgtatccggaattggggggttcttggtctcactgacttcaagaatgaagccatggacccttgcgagatgggggttccaccatgttggcccggctggtctcgaactgctgacctcaagtgacctgcctgtctcggcctcacaaatggctgggattacaggcacgagacaccgtgcctggcctgggaacatgtttacatggactttgtcactttttaaaacaaactgagggtaacttactagatctgtgaactaaagaangagaaaaaaaagaaagaaaacaaaca

SEQ ID NO: 17276 - DNA, 122 bp, Homo sapiens
  misc_feature 27: n = A,T,C or G
aagacttttgactgccattttgtttgntcagtggagactccctggccaacagaatccttcttgatagtttgcaggcaaaacaaatgtaatgttgcagatccgcaggcagaagctctgccctt

SEQ ID NO: 17277 - DNA, 174 bp, Homo sapiens
gtttattgaaggaaaaaaataagcttcaggagatctcgccaagtgtctaacaaagtgaacaaagagatcagtcagtctcagaagtactggcagcaggttctctcaagcttctcatttccaaaaattgatatataaaaatcttgaatgaagaactaaggcattaaaacacaggcc

SEQ ID NO: 17278 - DNA, 300 bp, Homo sapiens
  misc_feature 3, 23, 36, 109, 112: n = A,T,C or G
aangcgaactactatactcaatngatccaataactngaccaacggaacaaggttaccctagggataacagcgcaatcctattctagagtccatatcaacaatagggttnacngacctcgatgttggatcaggacatcccgatggtgcagccgctattaaaggttcgtttgttcaacgattaaagtcctacgtgatctgagttcagaccggagtaatccaggcggtttctatctacttcaaattcctccctgtcgaaaggacaagagaaataaggcctacttcacaaagcgccttcccccg

SEQ ID NO: 17279 - DNA, 470 bp, Homo sapiens
  misc_feature 145, 156, 353, 449: n = A,T,C or G
cagcttcagctcaactcacagcttctccaagcatcaccctgggagtttcctgagggttttctcataaatgagggctgcacattgcctgttctgcttcgaagtattcaataccgctcagtattttaaatgaagtgattctaagatntggtttgggancaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagnaattgcctagaaatatctttctcttacctgtatttatcaattttcccaggatttttatacggaaaaaatggattgaaacacttagatgcagtgganaagaggaatttgggataatat

SEQ ID NO: 17280 - DNA, 148 bp, Homo sapiens
atcaggttagcaaaaattctggctatcaagacctctcctggggcccattccctaagaatgtatcccttgtgctaaatagagtatgtatgtacaggcacactgtacatggtttgaaatacttgaataacagttcttcagggattactgt

SEQ ID NO: 17281 - DNA, 428 bp, Homo sapiens
  misc_feature 312, 332, 405: n = A,T,C or G
tgtattctgcggaactagcacctactgtgtgctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgccttttggatttctttttaataatgtgtgacccttcacctttgatcccctgacctgcattaccttggaaccatttcattttttaatttaatttcattttttaattttggggacaagctgnaacatttcatctttcaaagngtaacacgctgattcctcaaatagagatacccctttgagtgataaatttgcaaaatgctggcttcatttctgnattaaaattcatttcagtttccc

SEQ ID NO: 17282 - DNA, 509 bp, Homo sapiens
  misc_feature 9, 15, 45, 55, 56, 340, 448: n = A,T,C or G
cacccagtntttggnctacattcagccagctcagggcattcagantttggtgggnnggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggatcaacacatntgtactatccactactgcttcaagttccatgggacaaactaaaagtacaagctcaggtgggaggaaatcgaaaatgtaatcagggaacaaagcaaaaaccagcctttnggatgctagaggtggacaaaatcaaagataagaaaccaagggaagaaagccaatgggaaag

SEQ ID NO: 17283 - DNA, 129 bp, Homo sapiens
aatgtggtgctggggtgtttatggcaagtcactttgacagacattattgtggcaaatgttgtctgacttactgtttcaacaaaccagaagacaagtaactgtatgagttaataaaagacatgaactaac

SEQ ID NO: 17284 - DNA, 173 bp, Homo sapiens
  misc_feature 127: n = A,T,C or G
catttacatatttgataaaagaattgatttgccaatcctaaatgtgtaagtagctaacaacagaatttaaaaatagatgaagcaaaatctgatagaacttaaaggagaaatagggaattcaataatnataatagaaaatttccacattcttctcttacgaatagaacttagta

SEQ ID NO: 17285 - DNA, 359 bp, Homo sapiens
  misc_feature 212, 261, 321: n = A,T,C or G
acattttaatttcattattcaataagcatgagtacttatgaatgggatatgtgcacctgttgggtgtcacatgacctttcaaatcttggagtcagattggacaccaccatgcccatttccagttcaactctgatttttgtgtggtacatgctttttatcacagtgactgccagaaatctaacttcatatggaatcatgaaaagggatgtagngtgatcttgatttcaaaactatgatcaatctagagctagtttacaaggngtctaacagtgatcaagtatcactgtatttccctagaaaacctgaaatatcgatgaattntctgtggcactctggggcccttgggcacactatgggga

SEQ ID NO: 17286 - DNA, 176 bp, Homo sapiens
  misc_feature 65, 130, 137, 141: n = A,T,C or G
gccagacatggcccatgtaacatggacatgagcatggacagcataaaatggaacttccagattanagacaatggaagatagaagggacaccattagaaactatccagaagaagctggctgcaaaagggcnaaggganccanggggccgcaatgaagcttggagatacatgggtggc

SEQ ID NO: 17287 - DNA, 111 bp, Homo sapiens
  misc_feature 32, 39, 48, 49, 50: n = A,T,C or G
gtgtatctaatactaaccaatctgctggatgnggaaagnaaaaaatgnnngctaaactacccaagtaagatttactgtattaaatggccttcgggtctgaaaagctttttt

SEQ ID NO: 17288 - DNA, 319 bp, Homo sapiens
aagtttaaaagacatatgggacacagaagttctaaaatatgtgtgactgaagttccagaaggaaaggagagaaacaaaaggacagaataacttcgcaaaactaataaaagaaagcaaacaacaaattcataaagtgcagtgaaccccaagcaggataaatacaagaaaatcacagctagatgtatgaatcaagcctccaaattataaagaaaaagtttcaaaagcaaccaagcaaggttgtttttatttttcaaggaacaacaataatgatattgacagtgacttgttaacagcaactgtgaactccaaagacaatggc

SEQ ID NO: 17289 - DNA, 137 bp, Homo sapiens
  misc_feature 8, 9, 42: n = A,T,C or G
ctgttagnntacatacgctaccttgatgaaagggaccttcgngcaactgtagtcatcttaaaggcttctcatccactgtgcttcttaatgtgtaattaaagtgaggagaaattaaatactctgagggcgttttatat

SEQ ID NO: 17290 - DNA, 591 bp, Homo sapiens
  misc_feature 48, 298, 500, 539, 546: n = A,T,C or G
ctagcatcaccagtattagaggcaccagcctgcccagtgacacatgtntaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggntggggcgacctcggagcagaacccaacctccgagcagtacatgctaagacttcaccagtcaaagcgaactactatactcaattgatccaataacttgaccaacggaacaagttaccctagggataacagcgcaatcctatctagagtccatatcaacaataggggttacgacctcgatgttggatcaggacatcccgatggngcagccgctattaaaggtcggttggtccaacgattaagncctacgngatctgagtcagaccggggtaatccaggtcgggttctatctactt

SEQ ID NO: 17291 - DNA, 337 bp, Homo sapiens
  misc_feature 31, 56, 63, 80, 90, 95, 107, 192, 195, 212, 216, 224, 255,287, 289, 300, 313: n = A,T,C or G
taccttatctagcattgctcataaaagtacncatgttcatcctttttggaaactantaatcgngctagccttagatcatntcaagctccnttgcncaaaccaatcantgatgtgcagtatgaccagcagctagtaagtctgtggtgctaccagtatagcttggaagatgggtctgaattaatacctcagaanganatcaaaagtaaaagagnggtnctattgcnaaatatatggactagctttcttataacaatnttactttgaaattcaaagttccaaagctaaangnctaaaagaagnaactgcagcttgnctgctgattttggaaaatagtatt

SEQ ID NO: 17292 - DNA, 302 bp, Homo sapiens
  misc_feature 137, 294: n = A,T,C or G
agatgtatatagtaatatgattctcatacccaggaactgtaaatttaaacctaaatatttggccaatagttttcagacttaaagcatcatagtccttttatatttgtctttgtattttataagatactctgtaatgncatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggntttatgac

SEQ ID NO: 17293 - DNA, 174 bp, Homo sapiens
  misc_feature 33: n = A,T,C or G
tttaaaaaaccagagaagcaagagcaaacaaantcaacagctaccagaagacaagaaataactaaaatcagagcagaactgagggagatagagacaggaaaaaacttcaaaaaaatcagtgaatccaggagctgttgttttgaaaagatcaacaaaataaatagactgctagcc

SEQ ID NO: 17294 - DNA, 409 bp, Homo sapiens
  misc_feature 337, 357: n = A,T,C or G
tgactcatgatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttaggctcatttgagataaagtcaaatgccaaacactagctctgtattaatccccatcattactggaaagcctcatttgaatgtgngaattcaatacaggctatgnaaaatttttactaatgtcattattttgaaaaaataaatttaaaaatacatcc

SEQ ID NO: 17295 - DNA, 153 bp, Homo sapiens
  misc_feature 43, 44, 45, 117, 118, 119: n = A,T,C or G
tgtacatcccctttttccctaaatcaggttatgtttgtatttnnnggcttatagttgtagcagtaatgttcattgttaaatttataacaatgaaatcttcttttagggcatataatnnnattgatagtatcttagaatcatttatttaaaaaa

SEQ ID NO: 17296 - DNA, 295 bp, Homo sapiens
ctcttgtatgatattccccacctctacctcctggccccccatggggcaaggaccgtctggaatgagggtcttatgaactttcaggtgagataggttggaatttttttatgaccatgcttcctaggagaaaggcagaagtgaccttcttgctctgtagttttctcaattgcaaggcccatattttggggttattgtgttctaagcttgacatgtccgaaaagtagttcctgaaatacattaatggagtctgtagtctcagaatcatttttaaaatatggaagtatactttttagag

SEQ ID NO: 17297 - DNA, 405 bp, Homo sapiens
  misc_feature 375: n = A,T,C or G
gcaagattggacatggtctcctctgattatcaggtactggggctgagggcattaaaaatagtaagcctccctcctcgtcccctgcctcaagaaattgcctccttatttatcaacatctttttcccccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgcaagtcatgatggagacttcaggtggtctgnataaaatgcaaaataaatgttttattaacg

SEQ ID NO: 17298 - DNA, 280 bp, Homo sapiens
  misc_feature 33, 43, 44, 67, 105, 221, 236, 274: n = A,T,C or G
gaactttcctcttaaaagagacagtgggaactnccagccaggnntttggaaaaggcctgtgggctantaatgagagtgagctgcaaaaggaggaagggaacgtgngggtactttgaagtacttagctaggtgttttctacagtatcttatataattgcatcttacagcatctttacatgcgaaatagtttatcagtcatcttcaattgcatattacaaaantctgattaaattttnctcaaataagaaaactatcatttcatatgacacgaaancctaac

SEQ ID NO: 17299 - DNA, 214 bp, Homo sapiens
  misc_feature 12, 170, 203, 204: n = A,T,C or G
ctggatgctaantccattcagtccaccatctccagctcgcagaattactgaagtttggggtattccttcccccattgatactgtttttactaggtgcaactgtgaaggaaaaactttcttctttaaggattctcagtacttggcgttttaccaatgatttaaaagatgcnagggtaccccaaacccgattttcaaaggatttnnggagggactt

SEQ ID NO: 17300 - DNA, 134 bp, Homo sapiens
aaactatgatgtggagaaaggactaacatctcctccaataaaccccaaatggttaatccaactgtcagatctggatcgttatctactgactatattttcccttattactgcttgcagtaattcaactggaaatt

SEQ ID NO: 17301 - DNA, 363 bp, Homo sapiens
  misc_feature 235, 336: n = A,T,C or G
gccgacaagggaagataggtatttggttatgcttccataaacagtgaagaaatttgtagatacaagttcctgggcttatgttatagatatacttacactgtattctaagtgttactctcgtttttcttcatggttcccgctacattcttttgcttggctgctgcattttagcagtaaaaatgtcctttcagcctgcacgcctgtagtcccggcactttgggaggccaaggcgggnggatcgcctgaggtcaggagtcgggactggccggccagcatggagaaaccccgctctgctaagactgcaaaaattagccggcgtgttgcagcacctgtagncccgctactcgggaggctgaggcggga

SEQ ID NO: 17302 - DNA, 197 bp, Homo sapiens
tttctggcctggaggctatccagcgtactccaaagattcaggtttactcacgtcatccagcagagaatggaaagtcaaatttcctgaattgctatgtgtctgggtttcatccatccgacatttgaagttgacttactgaagaatggagagagaattgaaaaagtggagcattcagacttgtctttcagcaaggactg

SEQ ID NO: 17303 - DNA, 427 bp, Homo sapiens
  misc_feature 7, 73, 142, 191, 197, 199, 228, 230, 308: n = A,T,C or G
ccaaganggccaccacggacttcaaaatagagtaacaggaactggatttattctcacacctaaaaaaaaaacnaagcattaagccaaatatattaaagacattgacgatcagacaacaaaggacacagatgggaaacaaagngagtcttataattgccccccaacaggaaggagaattccaggcatggccncatgancnccctaagttcaggaggtaaagctgggagncntgggagggaagagtattggatgtaagacagcttcagtgagagagatcaccagaggatgtgagaggcctcccctggagncttcaactaagtgctaatcagcaaatgtatgaggaaactacccaagaccaatgagagaaccacccaaaaggattagaagaaactactcagagatctcatgggactgggaggaggtctgt

SEQ ID NO: 17304 - DNA, 207 bp, Homo sapiens
tagtctagtctagtctagtctagtcatgtgtgactgtgtactgagataccactagcccagtttgctgggtctctatgttttgggaagttgggggtttaataatattttaatgtctttttaggatcataaacataaataggtttgttgatattcaggccttcagaatttaaggggttttaaatattagcattcaagattgtaattggg

SEQ ID NO: 17305 - DNA, 160 bp, Homo sapiens
  misc_feature 30, 56, 85: n = A,T,C or G
aacttaaaataatcaagaaagtgtggtgcnggcataaagataacaagtacaaccangggacagaatagaaatccaagaaacagancacatttatatgatcagtggctaatgtgaaatttttgcagtaagtggcgttaggataattggatattcctatgcc

SEQ ID NO: 17306 - DNA, 205 bp, Homo sapiens
  misc_feature 42: n = A,T,C or G
atagagattaatacaactacttaaaaaatatagtcaataggntactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatgggagtaaaaaa

SEQ ID NO: 17307 - DNA, 130 bp, Homo sapiens
  misc_feature 13, 34, 42, 63, 64, 70, 80: n = A,T,C or G
aacagctctttgnacactaggaaaaaaccttgtngagagagnaaaaaatttaacacccatagnnggcctnaaagcagccnccaattgagaaagcgttcaagctcaacacccactacctaaaaaatccctg

SEQ ID NO: 17308 - DNA, 344 bp, Homo sapiens
  misc_feature 84, 117, 129, 130, 152, 162, 165, 169, 179, 231, 233, 236,257, 258, 263, 327, 335: n = A,T,C or G
acagaccatttaattaatatttcctctgtttattcctcctctccctcccattgcatggctcacacctgtaaaagaaaaaagaancaaattgaatatatcttttaagaattcaaaacnagtgtattcacnnaccctagttcattataaaaaanatctaggcantgngganataaaactgntgggtattctacaacttcaatggaaattattacaagcagattaatccctctntntgngacacaagacaatctaaaagnnatatnggaaaacatggaaatattaaaattttacacttttactagctaaaacataatcacaaagctttancgaattgnataaaaaaa

SEQ ID NO: 17309 - DNA, 165 bp, Homo sapiens
ttttcttcccaaatcaaaataaaagaaatatgatcagagcttgaacacaggcttatttttaaaataaaaatatttttaacatggggtttccttattgaaaaatcagtgtattagtcataaaacaccatcattaagaataattgaacaataaaagtttgctttcag

SEQ ID NO: 17310 - DNA, 145 bp, Homo sapiens
acatgacaatttatttagaactagaaaagcaagagcaaacacattcaaaagctagcagaaggcaagaagtaactaaaatcagagcagaactgaaggaaatagagacacaaaaaacccttcaaaaaattaatgaatccaggagctg

SEQ ID NO: 17311 - DNA, 143 bp, Homo sapiens
tatatctgttatttaaaactgagagagaatatttaatgctattttaaaatataatttattgaaaatgtgaagtgcatcccaaagagagccatgtgaaggagtagaaaaaaatagaataaggtagagctggaagtagaatgaaa

SEQ ID NO: 17312 - DNA, 231 bp, Homo sapiens
  misc_feature 43, 44, 141, 170: n = A,T,C or G
gtttgtattttttatttacattttatatttttgtacatattgnnagggcagccatttttaatgatctcggatgaccaaaccagccttcggagcgttctctgtcctacttctgactttacttgtggtgtgaccatgttcatnataatctcaaaggagaaaaaaaaccttgnaaaaaaagcaaaaatgacaacagaaaaacaatcttattccgagcattccagtaactttttt

SEQ ID NO: 17313 - DNA, 193 bp, Homo sapiens
gaattaacgaaagcagtgtcaagacagtaaggattcaaaccatttgccaaaaatgagtctaagtgcatttactctcttcctggcattgattggtggtaccagtggccagtactatgactatgattttcccctatcaatttatgggcaatcatcaccaaactgtgcaccagaatgtaactgccctggaaagcta

SEQ ID NO: 17314 - DNA, 181 bp, Homo sapiens
  misc_feature 8: n = A,T,C or G
taacattnatttaataattgaatataaactgaaagcctagtttgttcagaatattataggagcagcattaccatgactaagctatagacactgattctttaagacttttgcaaaccagtagcaaaaataatgttcaataaacccgattacagcacaagaaaaaaggagtgtcaggtaccac

SEQ ID NO: 17315 - DNA, 191 bp, Homo sapiens
  misc_feature 111: n = A,T,C or G
gaaccaacattttatacatctgatggtgttcctttcactgcagctgatccagattaccaagagaaataccaagaattacttgaaagagaggacttttttccagattatganagaaaatggaacagatttatccggggcttggtgatccatacttgggatgatatttgaatgatgaggatggacccagagat

SEQ ID NO: 17316 - DNA, 363 bp, Homo sapiens
  misc_feature 12, 138: n = A,T,C or G
caaacaaatagnctatcaaccccagacactggtttgaagaatgttaagacttgacagtggaactacattagtacacagcaccagaatgtatattaaggtgtggctttaggagcagtgggagggtaccagcagaaaggntagtatcatcagatagcatcttatacgagtaatatgcctgctatttgaagtgtaattgagaaggaaaattttagcgtgctcacttgacctgcctgtagccccaggtgacagctaggatgtgcattctccagccatcaagagactgagtcaagttgttccttaagtcagaacagcagactcagctctgacattctgattcgaatgacactgttcaggaatcggaat

SEQ ID NO: 17317 - DNA, 284 bp, Homo sapiens
ggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatag

SEQ ID NO: 17318 - DNA, 505 bp, Homo sapiens
  misc_feature 60, 114, 117, 223, 316, 345, 358, 398: n = A,T,C or G
atgttttctctttgaaagatagagattaatacaactacttaaaaaatatagtcaataggntactaagatattgcttagcgttaagtttttaacgtaattttaatagcttaaganttnaagagaaaatatgaagacttagaagagtagcatgaggaaggaaaagataaaaggtttctaaaacatgacggaggttgagatgaagcttcttcatggagtaaaaaangtatttaaaagaaaattgagagaaaggactcagagccccggaattaataccaatagaagggcaatgcttttaggattaaaatgaaggtgactnaaacagcttaaagttaagtcaaaagttgnaggtgattaaaanaattgaaggcgatcttttaaaaagagattaaaccgaaggngattaaaagaccttgaaatccatgacgcagggagaattgcggcatttaaagcctaggttaacgcatttactaaacgccgacgaaaaatgggaaagataattggggag

SEQ ID NO: 17319 - DNA, 126 bp, Homo sapiens
  misc_feature 24: n = A,T,C or G
tttgaaataacaccaccagtggtnttaaggttgaagtgtggttcagagccagtgcatattagtggacagcacttagtagctgtggaggaagatgcagagtcagaagatgaagaggaggaggatgtg

SEQ ID NO: 17320 - DNA, 143 bp, Homo sapiens
  misc_feature 7, 75: n = A,T,C or G
gactcanctttctaagacattgttaaatgctgttccatttactaaactagatattaaaaaaagaacagatttggnggaaagttatatacaatccatatacaatgtacactctcagatttcattaaacatcttgttctaagact

SEQ ID NO: 17321 - DNA, 186 bp, Homo sapiens
taacccgagaatgcaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataagggaatgtgccatac

SEQ ID NO: 17322 - DNA, 394 bp, Homo sapiens
  misc_feature 3, 27, 29, 129, 204, 220, 354: n = A,T,C or G
ccncgtgtgaagccaccgtcatcatgncngaccaggaggcaaaaccttcaactgaggacttgggggataagaaggaaggtgaatatattaaactcaaagtcattggacaggatagcagtgagattcacntcaaagtgaaaatgacaacacatctcaagaaactcaaagaatcatactgtcaaagacagggtgttccaatgaatncactcaggtttctctntgagggtcagagaattgctgataatcatactccaaaagaactgggaatggaggaagaagatgtgattgaagtttatcaggaacaaacggggggtcattcaacagtttagatattctttttattttttttctttnccctcaatcctttttatttttaaaaataggtcttttggaa

SEQ ID NO: 17323 - DNA, 163 bp, Homo sapiens
gcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaag

SEQ ID NO: 17324 - DNA, 109 bp, Homo sapiens
  misc_feature 4: n = A,T,C or G
gcgncatttaaagcctagttaacgcatttactaaacgcagacgaaaatggaaagattaattgggagtggtaggatgaaacaattcggagaagatagaagtttgaagtgg

SEQ ID NO: 17325 - DNA, 204 bp, Homo sapiens
  misc_feature 165: n = A,T,C or G
aaccatgagaaattatcaagtacagatatcatatgatttgcttgaaatacttttgcattatgcgttactttctcctgaccttctaaaatggggcataagtccgaatttagaaagaggaaaccacatgtgtaataagggaaacagactaaggagacatgccatgtntttttcagatcttattgtgatggggtaaactgtttgaaa

SEQ ID NO: 17326 - DNA, 201 bp, Homo sapiens
  misc_feature 54, 158, 160, 163, 167, 168, 182, 190: n = A,T,C or G
ctctcctgtgtgtggaatagaggcccctcgtgctaccaacacttaccctgtgtntaaaaagatcttgtaccaagccaacggcgttcctggctctcctgcccacaggatgaacattttcggcttccttaggagttttgccctaccgtattccaaagcgngngcnggannctcatattgtctgnagctcacncagcccgcagc

SEQ ID NO: 17327 - DNA, 193 bp, Homo sapiens
  misc_feature 145: n = A,T,C or G
tttaacaaatattccctcctctagacattttagatactgtgcatataaagcaaaacattaaaataaaaattagaatttacagaatagaaattgtattaaaagacttggacatgccttccagaatttgacatgtaaattagggtangaggataaatatgggaaatagaatatttaaataatacaaacaataagc

SEQ ID NO: 17328 - DNA, 160 bp, Homo sapiens
  misc_feature 47: n = A,T,C or G
actaaaaatacaaaaattagccagatgtggtggcgcacacctgtaancccagctactcaggaggctgaggcaggagaattgcttgaaccccggaggcagaggttgcagtgagccgagatcgcaccgatgcactccagcctgggcaacagagtgagactct

SEQ ID NO: 17329 - DNA, 190 bp, Homo sapiens
acacggcacataaattggattcaggaccacgtagacctaacagatatttatagaacattctccccacagccgcaggacatatattcttctcatcagtgcatggaacgtttttcgaggatggactatatgtcataccaaaaaacaagtctcaataaattgaaaaaaaccaaaaatgatacccaagtatctt

SEQ ID NO: 17330 - DNA, 249 bp, Homo sapiens
  misc_feature 12, 13, 14, 23, 32, 37, 42, 43, 65, 75, 76, 77, 99, 170,173, 199, 227, 237: n = A,T,C or G
atatgaccaagnnnaaaactccngaggagatncgcangaccnncaataccaaaaatgactccacngaagaggagnnngcccaggtacgcaaagagaacnagtggtgtgaagagaagtgaaatgttgcgcctgacactgtaacactgtaaggattgttccaaatactagtngcnctgctcggtctataatgggtaatatnagacaaacagaagacaaatgcagcagcnagtcaactgnattagcagaata

SEQ ID NO: 17331 - DNA, 300 bp, Homo sapiens
  misc_feature 135, 220: n = A,T,C or G
aacagcaagagcaattactactcgttctgggcagaccttatccaaagtctggtacaactgtccttagactgatgagcaaaggaggagtcaactaatgaagaaatgaataataaattttgacactgaaaaacattntattaataaagaatattgacatgagtataccagtttatatataaaaatgtttttaaacttgacaatcattacactaaaacagatntgataatcttattcacagttgttattggttacagaccatttaattaatatttcctctgtttattcctcctctccctccca

SEQ ID NO: 17332 - DNA, 177 bp, Homo sapiens
tttgaaagatagagattaatacaactacttaaaaaatatagtcaataggttactaagatattgcttagcgttaagtttttaacgtaattttaatagcttaagattttaagagaaaatatgaagacttagaagagtagcatgagggaaggaaaagataaaaggtttctaaaacatgac

SEQ ID NO: 17333 - DNA, 298 bp, Homo sapiens
  misc_feature 5, 142, 147, 202, 215, 265, 275, 286: n = A,T,C or G
actgnaagagccaaattccttttaactgacttttcttttaattcagtacacaagtatagagtgctataaaatagctacactaggtggcatcaacaatttctgtatatggtcaggatcgtgtgccactattttattttatttnatttnatttttagtactgaaagctcttctcagttacctttttattctccatcatcatggnatatggagaagangtctagtattcccatttacaacaggaaaactaaggcccaatttaagattngactcccttnaaagaccaatntgagatgaatta

SEQ ID NO: 17334 - DNA, 220 bp, Homo sapiens
cactgagaactgcgtgcataggacctcaaaatacaaaattagcagggcctcacagtcagcttcctcatggctagtttttcccccttatattacaatttttgttttataaagtcattttttttcctgatatttccaccacttttcagagtcatctacaaaatttttctttcctcaagaaaagagttccttttgccttattccttatgccttccccactgga

SEQ ID NO: 17335 - DNA, 109 bp, Homo sapiens
ttagcagacccagcttagagttcttctttctttcttaagccctttgctctggaggaagttctccagcttcagctcaactcacagcttctccaagcatcaccctggggag

SEQ ID NO: 17336 - DNA, 416 bp, Homo sapiens
caggagtgagtgcactggttaaaagtgagttcagaagttttcttatgtgccaatacagctcgatagaagtggataaaggtagcatctactttggaatgctcaacatgtcactgctgtactccttcaacatgggctaattcagacttttgctttgctgcttaccacttttatatttttattctcaaggctatattttttttggatgctttttggaatggggcctcaaactgctggctttgggaagcaggctggaagatatcaggataaaatttttaaaagctctgattttggctggaggttaaaaaacaacaaacaaaaacttggggaattgggggatcaccaaacatagaaataggcttactcttcatcttcttcccttatatactcacagttcaccccctttgggattcttttct

SEQ ID NO: 17337 - DNA, 507 bp, Homo sapiens
attcctgaagctgacagcattcgggccgagatgtctccgctacgttggccttagctgtgctcgccgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgctgctttttaatattgatatgcttatacacttacactttatgcacaaaatgta

SEQ ID NO: 17338 - DNA, 135 bp, Homo sapiens
tggcctggaggctatccagcgtactccaaagattcaggtttactcacgtcatccagcagagaatggaaagtcaaatttcctgaattgctatgtgtctgggtttcatccatccgacattgaaagttgacttactga

SEQ ID NO: 17339 - DNA, 182 bp, Homo sapiens
  misc_feature 169: n = A,T,C or G
cattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagaagtcaganctttctccttgaa

SEQ ID NO: 17340 - DNA, 239 bp, Homo sapiens
  misc_feature 22, 38, 43, 80, 82, 85, 92, 93, 104, 105, 119, 120, 121,126, 139, 158, 162, 163, 183, 184, 185, 197, 200, 214, 216,218, 229: n = A,T,C or G
taatctacaataagggcttagngctttagaaaaaagtnaaaantggaagtcattaaaaaaagactgttataatggtgtanangtnggggttnnttttctaagcnnctttgtcttaaatnnnaaaanagtgaatatgttngagactccctttgaccttncagnnccccaagttcattgttaacnnngcatttgcaatnggngcaaaaatacagantncngtcggctgaanacacaaaaag

SEQ ID NO: 17341 - DNA, 168 bp, Homo sapiens
accttctgcataatgaattaactagaaataactttgcaaggagagccaaagctaagacccccgaaaccagacgagctacctaagaacagctaaaagagcacacccgtctatgtagcaaaatagtgggaagatttatagggtagaaggcgacaaacctaccgagcctgg

SEQ ID NO: 17342 - DNA, 168 bp, Homo sapiens
  misc_feature 86, 134: n = A,T,C or G
ctagaaattaaaaaggagtaacacatacaattttcaacattcatcttttcccagcattttgaattattcttaaagttggcgacagntcaccattactactgtatatctggaataccctgtgtctaacttgattncatcttaattcacttcacattggaccccggaacc

SEQ ID NO: 17343 - DNA, 368 bp, Homo sapiens
  misc_feature 324: n = A,T,C or G
gcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccgcaactcaagataccacaccattcaaaantactactcttaaaacaactactcttgccccaaagtaactacaac

SEQ ID NO: 17344 - DNA, 222 bp, Homo sapiens
tttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaa

SEQ ID NO: 17345 - DNA, 285 bp, Homo sapiens
  misc_feature 36, 178, 188, 238, 245: n = A,T,C or G
aggatcactttacttgaaatcgttgtgcttttgagnggccgccgtggttgcgctgaagagggaggagggggagtctttccagtagttataccttaatttgtctctgcatggatgatatttgaaacctcaagcccaggcatgctgctctgtcctcccatctgtagctgcctgcgtgatnccatcatcgntccatttgtctcttcccattgctttgaacatttgtttttgggaacaaganatgcatnaggaaattactcaaccatgagtataactgatgcctataaa

SEQ ID NO: 17346 - DNA, 261 bp, Homo sapiens
  misc_feature 84, 179, 226, 241, 255: n = A,T,C or G
ctcgcggagctgaatgctagcttgctaggaatgagagtaaacaatgtttatgatgtggataataagacataccttattcgtctncaaaaaccggactttaaagctacacttttacttgaatctggcatacgaattcatacaacagaatttgagtggcctaagaatatgatgccgctagntttgccatgaagtgccgaaaacatttgaagagcggagattagtcagngcaaaacagcttggngtggatagaattgnagattt

SEQ ID NO: 17347 - DNA, 155 bp, Homo sapiens
  misc_feature 8: n = A,T,C or G
catacctncattggggaataagcataaccctgagattcttactactgatgagaacattatctgcatatgccaaaaaattttaagcaaatgaaagctaccaatttaaagttacggaatctaccattttaaagttaattgcttgtcaagctataacc

SEQ ID NO: 17348 - DNA, 336 bp, Homo sapiens
  misc_feature 32, 33, 68, 319: n = A,T,C or G
tgttggccaacacgcctcatctgagggagctnnacttggacaacaacaagcttaccagagtacctggngggctggcagagcataagtacatccaggttgtctaccttcataacaacaatatctctgtagttggatcaagtgacttctgcccacctggacacaacaccaaaaaggcttcttattcgggtgtgagtcttttcagcaacccggccagtactgggagatacagccatccaccttcagatgtgtctacgtgcgctctgcattcaactcggaaactataagtaattctcaagaaagccctcatttttataacccnggcaaaatcttgttaat

SEQ ID NO: 17349 - DNA, 198 bp, Homo sapiens
  misc_feature 7: n = A,T,C or G
cctccgnaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttctt

SEQ ID NO: 17350 - DNA, 147 bp, Homo sapiens
  misc_feature 56, 61, 116, 119: n = A,T,C or G
tttaactcttttagcaataaacgaaagtttaacgtaagctatactaaccccagggnctggncaatttcgtgccagccaccgcggtcacacgattaacccaagtcaatagaagccgncgnaaagagtgttttagatcaccccctcccc

SEQ ID NO: 17351 - DNA, 203 bp, Homo sapiens
acacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtaccatgcgtc

SEQ ID NO: 17352 - DNA, 157 bp, Homo sapiens
  misc_feature 61: n = A,T,C or G
actgatgtcatcttgagctcttcatttattttgactgtgatttatttggagtggaggcatngtttttaagaaaaacatgtcatgtaggttgtctaaaaataaaatgcatttaaactcatttgagagaatgccttttagtttaatgcatatttaaact

SEQ ID NO: 17353 - DNA, 188 bp, Homo sapiens
  misc_feature 13: n = A,T,C or G
gtagattttcagnggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaaattgctgcagtta

SEQ ID NO: 17354 - DNA, 433 bp, Homo sapiens
atgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaatcactagagctttggtcagtatttccttccctatatgtcacagagggcaccactgagaactgcgtgcataggacctcaaaatacaaaattagcagggcctcacagtcagcttcctcatggctag

SEQ ID NO: 17355 - DNA, 410 bp, Homo sapiens
ctggggtaggtttataaatgtctgtgcactatattaattagaagaccatagagcatgccagcaggttggctaatgctatgggggtttttaccacaggtgccattgtggaagaaattatttgggacattaataaaaaaaggtgggaaaacatgattttatcctcagggtataagatgggccagacaaatatgcttatttcctttctagaatataagggatattatttgcttatgacacttacacttttaatggcaggagcaatcagcctttacagctatcaaaatataatggggacccaatggaggattctttttactttgaaggtaattaggttgggactttgattggctggcaaacattttatcattggcaggaatttaatttaggattccaaaattgcttacagggtt

SEQ ID NO: 17356 - DNA, 194 bp, Homo sapiens
  misc_feature 123: n = A,T,C or G
tctcattttaggttaaatgataactagaaagattaaactagacagatagtttaggtggagtatatttttaaagctcagaacatgtatattggtcctgtgttaccaagtttatatgtgacagtngaaaaaagaaattcccttgaaatgatcatgaggttaaaaattttcttcattaggggacttgggagaaccca

SEQ ID NO: 17357 - DNA, 266 bp, Homo sapiens
  misc_feature 25, 34, 73, 86, 106, 115, 133, 144, 210: n = A,T,C or G
ggtttgttatttaagttatcctgtnaatatcctnctacctatctgtgcttgctgtttgaacgggactggggancaactttggatcnccaacatggaacaataaagnctacatcgntcagtgaactttgggcanaattactgtgnctaggacaccactacaatttcttttcactgttggcttcctgcccatccttgaactcaccataattngaaaaggcaggagatcataggaaaactaccaaaagaccaaccaagagctaaatagg

SEQ ID NO: 17358 - DNA, 133 bp, Homo sapiens
  misc_feature 124: n = A,T,C or G
ccactggctgccagaaactcattgaagtggacgatgaacgcaaacttcgtactttctatgagaagcgtatggccacagaagttgctgctgacgctctgggtgaagaatggaagggttatgtggnccgaatcag

SEQ ID NO: 17359 - DNA, 179 bp, Homo sapiens
  misc_feature 8: n = A,T,C or G
gatccttnttgccatcctggccgccttagcgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatag

SEQ ID NO: 17360 - DNA, 284 bp, Homo sapiens
tgatatcctccaggaatactggccagagggctgtgctgaagtttgctgctgcactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcag

SEQ ID NO: 17361 - DNA, 131 bp, Homo sapiens
gatagctatggctccactacaaaatgtttagtatcagtaggggtgtatgtgtgtgtttgtctgtgtgtatatgtacatttagtatatgtgttagtgaatccttttcttagacaagtcttaagcccttatac

SEQ ID NO: 17362 - DNA, 361 bp, Homo sapiens
atgtgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgcaatttgccatctctggtctgtgctataatcagaattgtaattatgttctccagaggccaatttcattaactctgattagttaggaatcagctagccagattaagtaacctctttggccagccttgattacagggca

SEQ ID NO: 17363 - DNA, 123 bp, Homo sapiens
  misc_feature 57: n = A,T,C or G
cctagctactcaggaaattgaggcaagaggattgcttgaacccagggatctgaggcngcagtgagctatgattgccctactgcactttagcctgggcaaccgaaggagaccctatctccaaat

SEQ ID NO: 17364 - DNA, 172 bp, Homo sapiens
ggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcaagacttgtcttt

SEQ ID NO: 17365 - DNA, 171 bp, Homo sapiens
  misc_feature 3: n = A,T,C or G
ggntaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaaggagaccatggaaaaagctg

SEQ ID NO: 17366 - DNA, 284 bp, Homo sapiens
ttgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaagggactacagagccccgaattaataccaatagaagg

SEQ ID NO: 17367 - DNA, 161 bp, Homo sapiens
  misc_feature 28, 38, 117: n = A,T,C or G
caacatccctgatgagtatttcaagcgntttaatgcantgcagtatctgcgtttatctcacaacgaactggctgatagtggaatacctggaaattctttcaatgtgtcatccctggntgagctggatctgtcctataacaagcttaaaaacataccaactg

SEQ ID NO: 17368 - DNA, 235 bp, Homo sapiens
  misc_feature 29, 36, 59, 151, 152, 223: n = A,T,C or G
tatgttactgtaccctgcagtgttgattnccaaaanagagttttctgcagtatgctttnagtctaagaaaagcacagatggagcaatactttccttctttgaagagaatcccaaaagttagttcatcttaaagtgcaatattgtttaatcnnaaaactgggcaactttggaagaacttttaacagaagcctcaatgatgatcactttgaattgcttgtgattncaaaaataaagc

SEQ ID NO: 17369 - DNA, 362 bp, Homo sapiens
aacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagttcggtcattgttgaacaaagctggaatgat

SEQ ID NO: 17370 - DNA, 171 bp, Homo sapiens
tttttttttatattgttactgttgctttttattctattttcctcccgcaatgtttttcatataaaattactttgaattgttttttgtttatttaatcaatatacacaggtgatgaaaggagggagaattgttggtaaaaagaggcacagagtcaaggtaatgttagaatac

SEQ ID NO: 17371 - DNA, 344 bp, Homo sapiens
  misc_feature 35, 78, 91, 102, 129, 188, 225, 274, 323: n = A,T,C or G
acaacctgtcaatccagatttgacctcatttgcantgccaccaaggcctcctgggaaaaattgtaggaatttatgggnataatattgtggnctgaatggcgngaatttttatcccgaggagggggcagntgtgacaacctccagtgcatgtgggaacagcatgaattgggcccttattcccagggggngccccatattccccaatactgtaaagcagatgctgtntagcacctgccaaggagccatatgccctgaagttcagcattaggcaggnatctcttaactgtaagacataccaggcccagctgggaccataatttggncagaacactggatggtgatta

SEQ ID NO: 17372 - DNA, 262 bp, Homo sapiens
atcaaagtgaagattagaaataaattttagaaaatgtagaatagtattgattctgtccctggaatagaatctcagtggagtttttttgcaaaactaatatggatttcatctgattttattatttcttaaattttagattttattgagtaccatttatatgattgtacaagcattcactctttagtagcattttttgtttttcagacaagctgaagtggttttattaagatttggtaatatttaaatagcaaccttctctgcc

SEQ ID NO: 17373 - DNA, 134 bp, Homo sapiens
  misc_feature 47, 76: n = A,T,C or G
aaactggaagagtctacaatgttacccagcatgctgttggcattgtngtaaacaaacaagttaagggcaagattcntgccaagagaattaatgtgcgtattgagcacattaagcactctaagagccgagatagc

SEQ ID NO: 17374 - DNA, 207 bp, Homo sapiens
  misc_feature 137: n = A,T,C or G
cattcttagacacatacaacctaccaagattgaaccatgatgttcaaaacctgaacagaccaataacaagtaatgaaattgaagctgtaataaaaagtcttccagtaaagaaaagtctgggacccagtggcttcacntgttgaattctaccaaatatttacaatataacctaatacccaaattgtacttgaaaactattccaaaaaa

SEQ ID NO: 17375 - DNA, 204 bp, Homo sapiens
aaatcaacaaaactgctcgccagaacactacgagccacagcttaaaactcaaaggacctgggcggtgcttcatatccctctaagaggagcctgttctgtaatcgataaaccccgatcaacctcaccacctcttgctcagcctatataccgccatcttcagcaaaccctgatgaaggctacaaagtaagccgcaagtacccacgt

SEQ ID NO: 17376 - DNA, 243 bp, Homo sapiens
  misc_feature 25, 36, 101, 168, 207, 212, 220, 237: n = A,T,C or G
tgctttccacttggggactggaccncaccagatggnacaacagactctcctttcttatgaaccttcgaacattgcagggattgtttgagtgttgacatagntactggtattggtgaattccccctgtagacttgcccctttgtgtcttcttatggaaggtccttttgngatcccagggtgatatggagagagttagagcctggtctngccanaaggactntagatctcatgattctngctcac

SEQ ID NO: 17377 - DNA, 287 bp, Homo sapiens
  misc_feature 25, 241: n = A,T,C or G
aagattcaagatcgacaagaagctnttgactggcttcttggtttagctgttagattgattgagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcnttaaggcaattcggattttttggtttcaagggagccgccttgacac

SEQ ID NO: 17378 - DNA, 251 bp, Homo sapiens
  misc_feature 30, 34, 63, 130, 190, 198, 203, 220, 235: n = A,T,C or G
aactctggttttgaccttcaggaaacattngttnaaattcaagcagaacattcagaatcaggncagcttgtgggtgtggacctgaacacaggtgagccaatggtggcagcagaagtaggcgtacgggatnactatcgtgtaaagaaacagcttcttcactcctgcactgtgattgccaccaacattctcntggttgangagancatgcgagctggaatgnctcctctgaaaggtngaatagaagcttcctc

SEQ ID NO: 17379 - DNA, 106 bp, Homo sapiens
  misc_feature 32, 34: n = A,T,C or G
gcaatcctgaacttcctgaagatgtccttgangngcagcgtggcattccttcgacttctctccagccgagcttcccagaacatcacatatcactgcaaaaatagca

SEQ ID NO: 17380 - DNA, 460 bp, Homo sapiens
ctaatcacaattttttttcttacccagccctgctctgtgctgtgaggctccggtaggagcagaggggagaggagagttctgatgttccagtgacaatgagaaggtgctttcattaacaaaagtgtaagacaagaatatttcagtcatgctgttacacctactgcctgatatagatcataaaggacaagaataaaatttaatttgcaataactctttggagctacagtaatagctgcccaggagttctttgcagagcatcttggcttttcattaagtactcagccctaaatttttttcaattctggcagaagcagccagggaacactttgggagctctataaaaggcctctcctaatctcaaatcattggaaagactctttagcatctgtaaaatattttcccttctaatctgcctgaaactaacagggagaaaatctgagatggttcttaattaagcagt

SEQ ID NO: 17381 - DNA, 182 bp, Homo sapiens
tttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcaca

SEQ ID NO: 17382 - DNA, 324 bp, Homo sapiens
  misc_feature 123, 190, 207, 215: n = A,T,C or G
tgttttctctttgaaagatagagattaatacaactacttaaaaaatatagtcaataggttactaagatattgcttagcgttaagtttttaacgtaattttaatagcttaagattttaagaganaatatgaagacttagaagagtagcatgaggaaggaaaagataaaaggtttctaaacatgacggaggntggagatgaagctcctncatggagnaaaaatgtatttaaaagaaaattgagagaaaggactacagaccccgaattaataccaatagaaggcaatgcttttagattaaaatgaaggggcctaaacagcttaaagg

SEQ ID NO: 17383 - DNA, 163 bp, Homo sapiens
  misc_feature 20, 112: n = A,T,C or G
agagctcatggaaggcgagngggaacccggctgcctgcctttttttctgatccagaccctcggcacctgctacttaccaactggaaaattttatgcatcccatgaagcccanatacacaaaattccaccccatgatcaagaatcctgctccactaagaatggt

SEQ ID NO: 17384 - DNA, 165 bp, Homo sapiens
cccagctgctcaggaggctgagacaggagaaacccttgaacccaggaggtggaggttgcagtgagccgagatcacgccactgcactccagccggggcgacagtgcgagactccatctcaaaaaaaaaagactttctccccaccagactgtaaactcctccagggg

SEQ ID NO: 17385 - DNA, 347 bp, Homo sapiens
  misc_feature 160, 178, 244, 276, 283: n = A,T,C or G
tttgtacagtttatcctgatgttgcttgtaatgcagtagaggctatttcgccttcgcttttctttctcgacctttttgtaaaccctataattatgaagcgattgcttgagaaaataacatataaacatagaatagaatagactgccaaggtggtcacagnttctttttttaactaggntatttataatgtatttctgaaccacttgcagacaaattcacaacacttaatgttcatattttgagnaaaggaagctaaaaccatgtttggcttctggnactacangcattagcgaaaggttaagtaagtttgttctccactgaagtaatacttaacatctcagaaaaaa

SEQ ID NO: 17386 - DNA, 143 bp, Homo sapiens
  misc_feature 9, 50: n = A,T,C or G
gaaccttgnttccctaaccctaattgatgagaggctcgctgcttgatggnagtgtacaaactcacctgaatgggacttttttagacagatcttcatgacctgttcccaccccagttcatcatcatctcttttacaccaaaagg

SEQ ID NO: 17387 - DNA, 372 bp, Homo sapiens
  misc_feature 312, 351: n = A,T,C or G
aagaaaaagcgaaggaatttcgcagagctgaagatcaagcgcctgagaaagaagtttgcccaaaggatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgcatcagaatcagaggtatcaatggagtgagcccaaaggttcgaaaggtggtgcagcttcttcgccttcgcaaatcttcaatggaacctttgngaagctcaacaaggcttcgattaacatgctgaggattgnagaccatatatgcatgggggg

SEQ ID NO: 17388 - DNA, 430 bp, Homo sapiens
  misc_feature 420: n = A,T,C or G
tgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatgcaagaaaaatgaaagacacagacagtgaagaagaaattagagaagcattccgtgtgtttgataaggatggcaatggctatattagtgctgcagaacttcgccatgtgatgcaaaccttggagagaagttaacagatgaagaagttgatgaaatgatcagggaagcagatattgatggtgatggccaagtaaactatgaagagttgnacaaatgatg

SEQ ID NO: 17389 - DNA, 114 bp, Homo sapiens
  misc_feature 29: n = A,T,C or G
ctaccttgatgaaagggaccttcgtgcancctgtagtcatcttaaaggcttctcatccactgtgcttcttaatgtgtaattaaagtgaggagaaattaaatactctgaggggcg

SEQ ID NO: 17390 - DNA, 183 bp, Homo sapiens
cccaaagcacgatgagggcagcagccatgtgtatactaacatgaagaacgttggaaaaacagtaagtgctttgaaatagttgcatacttggtatgtttgagggaaagtaaggaggcatttgtggcaggagtgggagagattggactgggagactcagcaggaaatcaacttgaataggaaagg

SEQ ID NO: 17391 - DNA, 422 bp, Homo sapiens
actttaatgttaattgttacttgaaaacatatctgggatccctttttttggcctgtgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgcattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacaggtttt

SEQ ID NO: 17392 - DNA, 351 bp, Homo sapiens
tggggtgctactgcctgtgggttgctggcttaaaggacgattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttat

SEQ ID NO: 17393 - DNA, 150 bp, Homo sapiens
gccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagcc

SEQ ID NO: 17394 - DNA, 134 bp, Homo sapiens
  misc_feature 106, 109: n = A,T,C or G
ttattttgtttcatgcacaaaattattaaaaatattgtgtaaaattagcttcaggctctgtgtataaggtgtatatgaaacataaatgaatttcatgtttagactnggntcccatccccaatatatctcattat

SEQ ID NO: 17395 - DNA, 188 bp, Homo sapiens
gctagcaaaagtgaactatgtgaaaaacaacatttgttttatgagtcatcaccaagaagaattagtgccaaaacagcctcaaaaaagaaaaccccaggagcagctcttggagtgtaacaagctgtgtggtaggggccaatccaggcagctttctccagagacctaatggcctcaacaccttctgaacg

SEQ ID NO: 17396 - DNA, 184 bp, Homo sapiens
  misc_feature 13, 152: n = A,T,C or G
acttttccagaantgccggacgtcgggcaagcgtctatatcaccttgaagaagtatgacggtcgaaccaaacccattccaaagaaaggtactgtggagggctttgagcccgcagacaacaagtgtctgttaagagctaccgatgggataganagaagatcagcactgtggtgagctccaaggaa

SEQ ID NO: 17397 - DNA, 176 bp, Homo sapiens
gtaatgatatgaatgattgcgaactcccttgtctactactgcaaaatagtttccaataccagtgttgactggaattctaatctcatgaacaataacctttcagctggaaaggggagaagtgtttctatcttctaagaactctgcattatttttagaagtttctcagttctcaggct

SEQ ID NO: 17398 - DNA, 179 bp, Homo sapiens
tttttcctatacatacatacctatgataaagtttagtttataaattaggcacagtaagagattaagagtaactaataatcagaacaattataacaatatattctaataagagttatgtgaacatggtctctctctctcaaaataatattttcagaccacagttgactatgggtcaactg

SEQ ID NO: 17399 - DNA, 340 bp, Homo sapiens
tgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgctcccagcccaggccagaagacctcccttcaggtgcccgggcgcaggaactgtgtgtgcctacacaatggtgctattctgtgtcaaacacctctgtattttttaaaacatcaattgatattaaaaatgaaaagattattgg

SEQ ID NO: 17400 - DNA, 118 bp, Homo sapiens
  misc_feature 7, 55, 81, 115: n = A,T,C or G
tgctaantatattattatctgcacatttttatggtttatttatgtacactgctgngaagacatggtatttttatttctctnattgcaaggtcttttatagtcgcccattttctcntgg

SEQ ID NO: 17401 - DNA, 192 bp, Homo sapiens
aacattacatgcaggccacctactcatgcacctaattggaagcgccaccctagcaatatcaaccattaaccttccctctacacttatcatcttcacaattctaattctactgactatcctagaaattcgctgtcgccttaatccaagcctacgttttcacacttctagtaagcctctaccttgcaccgacaa

SEQ ID NO: 17402 - DNA, 515 bp, Homo sapiens
caacagcatctctgttgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgaagtcttttcagcaacccggtccagtactgggagatacagccatccaccttcagatgtgctacgtgcgctctgccattcaactcggaaactataagtaattctcaagaaagccctcatttttataacctgcaaaatcttgttaatgtcattgctaaaaaataaataaaagctagatctggaaacctaactgcaatgtggatgttttacccacatgacttattatgcataaagccaaatttccagtttaagtaatgcctacaataaaaagaaattttgcctgccatttcagaatca

SEQ ID NO: 17403 - DNA, 112 bp, Homo sapiens
  misc_feature 8, 105, 107: n = A,T,C or G
ttgcttanctctagggatttctaaactttgaacaataaaagttaattttagaaatactttcagggtcatcattaagctttagcgcggctttgttactgccctgtnanagtag

SEQ ID NO: 17404 - DNA, 157 bp, Homo sapiens
ttcttaacataatttaaaaatgaacaggttttaataaattattcttataccaagaactagatctcaaaatgaaggaaaattgcaattaatagataccaacactgagaggacagaggttgtttagagttatttgacaacagttttaaaatagtcatga

SEQ ID NO: 17405 - DNA, 238 bp, Homo sapiens
  misc_feature 35, 56, 183, 188: n = A,T,C or G
aaggaacaacccaattaaggatattagcatgggangattaagagaaaatagatganccgctatacatcatataaatatcattcaaatgaaagctggtgacactattaatatcggacaaaatatactttaagcaaaaatattattacagataaagagttattatttaatgataaaagaacaatncaccnggaagagttaatcctgagcctacattacctagtagcatccttttaaaaat

SEQ ID NO: 17406 - DNA, 153 bp, Homo sapiens
  misc_feature 94, 97: n = A,T,C or G
tgtgacttttgtgaaaattttgaattagctttcatatgaagtgccttaagtagactcttcatttacttttctggcaatggtttaaatatcattngcnatgcatttttaagatacagttcagagtgacacattgtagtggcaaagataaccaaa

SEQ ID NO: 17407 - DNA, 547 bp, Homo sapiens
atacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaggctgtgagactacctattgtagatattgcaccctatgacattggtggtcctgatcaagaatttggtgtggacgttggccctgtttgctttttataaaccaaaccctatctgaaatcccaacaaaaaaaaatttaactccatatgtgttcctcttgttctaatcttgtcaaccagtgcaagtgaccgacaaaattccagttatttatttccaaaatgtttggaaacagtataatttgacaaagaaaaatgatcttctctttttttgctgttccaccaaatacaattcaaatgctttttggtttatttttttaccaattccaatttcaaaatgtctcaatggtgctataataaataaacttcacactctttatg

SEQ ID NO: 17408 - DNA, 540 bp, Homo sapiens
gaaatgagaatctgatcaataaattaggtcaagcataagattaaaacagaatattctgtggtgccagtgcacacgtaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagccggactgggtaagtaaaagacaaacattatttccaccataaagtatgtattgaaatcagggtggctctgtgtacaggaatacatacttattcccattttaagcattgcttctgttttcctacctagaaggcagaggtttttcagtatctccccattggcaaagtggcctcaagaaacattttcattaag

SEQ ID NO: 17409 - DNA, 631 bp, Homo sapiens
gtaccccaaaccaattttcaaaggatttggtttactaactggacaaatagtggcagcgctttcggcagctaaatataagaactggctgaatctgtgtattttttcaagagaggtggcagcattcagcagtatatttataaacaggaacctgtacagaagtgccctggaagaaggctgctctaaattatccagtggatggagaaacgacacagggtaggagacgtcgctttgacggctataggaccttctcaaacacacaccatcagaattcaatattcacctgccagactggcttatcgagacaaaggtgtcttcataatgaagttaaagtgagtatactgtggagaggcttccaaatgtggtacctcagctatatcactgcccacatcaggaaaacctgacggtatgattactatgccttttctaaagatcaatactataacattgatgtgcctaggagaacagcagggcaatactactcgtctggggcagaccttatccaaggctgggacaactggccttagactggtgggcaaaggaggggcactaatggaggaaatgaataataaatttggcccctgaaaaacatttttttaataaagaatttggcctgggaaaaaaaaaaaaaaaa

SEQ ID NO: 17410 - DNA, 231 bp, Homo sapiens
gtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgtt

SEQ ID NO: 17411 - DNA, 574 bp, Homo sapiens
tagttgtaacatggactaatctgtgggagcagtttattccagcatcacccagggtgcagccacaccaggactgcgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttca

SEQ ID NO: 17412 - DNA, 514 bp, Homo sapiens
tgcggctggaaccatggagggtgtagaagagaagaagaattaggttgctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgcttcgtcaaatcttcaatggaacctttgtgaagctcaacaaggcttcgattaacatgctgaggattgtagagccatatattgcatgggggaccccaatctgaagtcagtaaatgaactaatctacaagcgtggttatggcaaaatcaataaagaagcgaattg

SEQ ID NO: 17413 - DNA, 449 bp, Homo sapiens
caatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagattactgaaagcaaatgtgaaaatcttcaaatcccagggtgcagccttagataaatacgccaagaagtcagttaaggtattggtgtgggtaatccagccaataccaactgcctgactgcttccaagtcagctccatccatccccaa

SEQ ID NO: 17414 - DNA, 109 bp, Homo sapiens
cacctgtaatcccagcactttgggaggctgaggctggcgaatcaccagagttcaagagttcaagaccagcctgggcaacatggcgagaccccatctctactaaaaatac

SEQ ID NO: 17415 - DNA, 393 bp, Homo sapiens
atatctatatttttgaacatttgtacaagtataaatgcatggtaaattcctagaggtaaaattactgagtcaagagttttacatgttttgtgaattttgatagatattgtaaagttgttcttcaaagaagtttcatttattgttttcccacatttagccaacattaggtattatgaaacttttttatattggccaaaactcacaggcaaaagaaaaagaaaaaagtctcattgttttagcttggtatttatttgcttatggtgagggtaaatgtagtaaaaatgaaaaacccagtactatagaagatagagttgaagaaatattccagaaagtacaataaaaggagtaaaataaagaggtcaaataggagagtaaagataagaatattcactg

SEQ ID NO: 17416 - DNA, 178 bp, Homo sapiens
tgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgttggcactttcc

SEQ ID NO: 17417 - DNA, 287 bp, Homo sapiens
catgaggaggctggtcagtcacctcaaggatagtggcctaaagaagtctgaagtggtgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaactta

SEQ ID NO: 17418 - DNA, 445 bp, Homo sapiens
  misc_feature 5, 293: n = A,T,C or G
cagtnttctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagtctccagcttcagctcaactcacagcttctccaagcatcaccctgggagtttcctgagggntttctcataaatgagggctgcacattgcctgttctgcttcgaagtattcaataccgctcagtattttaaatgaagtgattctaaagatttgggttgggacaataggaaagcatatgcagccaccaagagccaaaggttttgaaaatgatatg

SEQ ID NO: 17419 - DNA, 159 bp, Homo sapiens
  misc_feature 25, 30, 78: n = A,T,C or G
actggcgccggatggctctggacgngaagnctcgggcaaagcgttatgagaagctggacttccttggggagggacagnttgccaccgtttacaaggccagagataagaataccaaccaaattgtcgccattaagaaaatcaaacttggacatagatcag

SEQ ID NO: 17420 - DNA, 276 bp, Homo sapiens
  misc_feature 29, 50, 202: n = A,T,C or G
ctttccacccacatccccaaatatgcagngagtagccgttgggtttcacngttgtaattggaaaaggtaaaagccagcctgaaaataattctggcctgttgggaatgttggcttcatgttttgagaattccctcgtgtccctgacttcagagttaactatttctttaatgaggactaacatgttagtgttgtctctgaactntatttgcaggtaattcactaatggaagctttcacagccaactctggtaatgaatgtagaacagcgaccttctgt

SEQ ID NO: 17421 - DNA, 146 bp, Homo sapiens
actataaggactcttgagcccgaaaaacattttgtgacttagcctgaggctaacaggaataaacttgtcccatgttcagatagtttaggcatatctgagttggtggaggaaatgtgatctgttcctagccctatgtgctaggcagg

SEQ ID NO: 17422 - DNA, 150 bp, Homo sapiens
  misc_feature 60, 122: n = A,T,C or G
agcagtgattaacctttagcaataaacgaaagggtaactaagctatactaaccccagggntggtcaatttcgtgccagccaccgcggtcacacgattaacccaagtcaatagaagccggcgnaaagagtgttttagatcaccccctcccc

SEQ ID NO: 17423 - DNA, 155 bp, Homo sapiens
  misc_feature 10: n = A,T,C or G
tttactccanaactctgttctttaaagaccaagattacattctcaattagaaaactgcaatttggttccaccacatcctgactactaccgtataagttttctctattctttcatttcccccttccccattcctttattgtacataaagtaactgg

SEQ ID NO: 17424 - DNA, 104 bp, Homo sapiens
ccttgaataaaaattgcacacactcagtgcagcaatatattaccagcaagaataaaaaagaaatccatatcttaaagaaacagctttcaagtgcctttctgcag

SEQ ID NO: 17425 - DNA, 141 bp, Homo sapiens
  misc_feature 4: n = A,T,C or G
ccanataatttattcttcccttaaaaatgctaagcagctataccagtacatgtgttgatcttgctgtttattgttgaagaaaagcattgtatagttaattttacttgcttctaggattaattctagaaaattcctaatgag

SEQ ID NO: 17426 - DNA, 129 bp, Homo sapiens
  misc_feature 33, 37, 65, 68: n = A,T,C or G
ggcagtatatgctgttgttcaaatgcctttggnaatngaaagtaaactacttgagggagctgcgntgnctccagctggttgtcctggcgtacaaggaggcgaggctatgcggtcgaggccaacttagtt

SEQ ID NO: 17427 - DNA, 547 bp, Homo sapiens
gaactaggtggaggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctgcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgcca

SEQ ID NO: 17428 - DNA, 435 bp, Homo sapiens
ctgactaatctaggtaaaaggttacctttactggtccgatgcgggaacacaggacacagaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaaacaagtgccttgatgtaattccatgtaaatcattgcttaaccctcttatgggatgaggatgagttattaatgtattgcagcctactggaaaggagggggagttggtaatagcagatacttttcttctagaagcttatgttttatgctggttattatgtaagacctggatgtgggtggagatttagaggttcatttgtttggctgctaataaatggtactctaatattcc

SEQ ID NO: 17429 - DNA, 540 bp, Homo sapiens
caagtgacttctgcccacctgtcacatgaccaaaaaggcttcttatgcgggtgtgagtcttttcagcaacccggccagtactgggagatacagccatccaccttcagatgtgctacgtgcgctctgccattcaactcggaaactataagtaattctcaagaaagccctcatttttataacctgcaaaatcttgttaatgcattgctaaaaaataaataaaagctagatactggaaacctaactgcaatggggatggtttacccacatgacttattatgcataaagccaaatttccaggttaagtaattgcctacaataaaaagaaattttgctgcatttcagaacatcttttggagcttctgtgatggtactgaccactagagatatcttattcactaaatggaaaattggggtaaatatatatgcaatattaggaagctttctttttaattccaggaaaaataaaaagggatgagctctggaatcatgagcggtagctcatttggagaaaagcaaagccaaacactagcttggataatc

SEQ ID NO: 17430 - DNA, 277 bp, Homo sapiens
gaaaaaccagacaactttgtttccagtgtctctgggataattgttacctttctccttttgcatattcacttattaacagcagtagaaagcttagtgtgatacaataatcatttttaaataatcctaaatctactcagggtgaaaagattctgacagcaggcgctttaaacagctgccctgagcaaaatagacactgctttcttttaaagttgaaaaggagaaaggtaacaattatcccagagacactggaaacaaagttgtctgatttttccccggc

SEQ ID NO: 17431 - DNA, 389 bp, Homo sapiens
gatatgtaaaaacagaaggggatttatcccaggaatgtacgatagtttaacattggaaaagtctgttatgtaattcattacattaacagattaaaggccaaaaaatatgtattactatgttaatacaagcctatgaacatttgacaaaattcaatacagatttacagtaaaattttcttagtaaactaggaatttaaggaaaatttcttagcctaattaagtttatgtatgaaaaacctacttaaggaatggtggcttatgcccgtactcccagtgactcaggaggctgaggcaggaagatcccttgagcccaggagtttgaggctgcaatgaactataactacaccactgcactccagcctggacaacagagagagacccctgactcc

SEQ ID NO: 17432 - DNA, 331 bp, Homo sapiens
cgttacagaccctagaggcagctaagtctcatttatagagatctgtcagcatctgcaggaactgcgtccagatggggaggatcttattgtgtagacacaatgagaaaatgttctattttggacaacctcccaagggccttttcatgcccaggaaagtgttttggggcatctagaacaaatagtcttggagttacagagagaagtttaggttggaggtacacatttagagagtactgatgatattgtacaagacagcatttagattgagaagagacaagtaaggttggtagaactctatcctggatcctggatgtgtgagcaggaagaattg

SEQ ID NO: 17433 - DNA, 151 bp, Homo sapiens
  misc_feature 57, 58, 59, 125, 136: n = A,T,C or G
actgagctgcaacttcttacttccctactgaaaataagaatctgaatatacatttgnnntctcaaatatttgctatgataggatgatggattaattaaataagtcaattcctggaatgtgagagngcaaataaagncctgagaaccttcca

SEQ ID NO: 17434 - DNA, 106 bp, Homo sapiens
  misc_feature 23, 81, 85, 95: n = A,T,C or G
aactttggtgcctgaacattaanagtagatgactgctttattcttgagctgtttaccatgcatgaagctgtcaagtcctgnaatnctgaggatcnaagatgtgatg

SEQ ID NO: 17435 - DNA, 225 bp, Homo sapiens
  misc_feature 21, 23, 33, 77, 79, 156: n = A,T,C or G
gaatcaagacgactgaaccgncngggacgagancagaaaccgtgacttatggcacttacctgggtaaggggcaagangncagcctggcagggaccgtggtcttgagtcaaagaaacaaatgggcacacagtaaaggaaaggaagcttatcttaaanagttcaattcagtgctaagctgattccctttattaatttaaatttgtgtattatgtatttttaaatttg

SEQ ID NO: 17436 - DNA, 151 bp, Homo sapiens
tatatattgtttagagcaacagacataggtgatacaaaactataaagaaaagcaaggaaaggctgggcgctggtgactcacgcctgtaatccaaactctttgggaggccagagcagaaggattcctgaggacaggagttcgagaccagcct

SEQ ID NO: 17437 - DNA, 468 bp, Homo sapiens
  misc_feature 8, 18, 341, 346, 348, 366: n = A,T,C or G
ttcatganaaaaaccctnaacaaactatgcatagacagagcataccccgtagataacaaaggccacatacaacaaacccacagttatcatactgcatggggaaaagtcgaaagcctttttttccaagaactggaacgagacaaggatagctactcttagctctttcattcaacataggactggaagtcctagccagagcagtcaggcaagagaaggaaataaaaggcctccaaattgaaagagaataagtgaaagtatctgtttgcttgtgacatgattatacacctagagaagctaaagactcctccaaaagactcctagacttcataaacacattcagnaaagntncaggatacaaaaatcagngtgcaaaaatcagtagcatttccatatactgataacattcaagttgagagcaaaatcaagactcaatcccatttacaatagacacccacacacacaaataaa

SEQ ID NO: 17438 - DNA, 366 bp, Homo sapiens
  misc_feature 30, 201, 268, 323: n = A,T,C or G
aatcatttatctggatttttatgttttatnagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgncaaatatatttaactatttagagaatgatttccacctttatgttttaatatcctaggcatctgctgnaataatattttagaaaatgtttggaatttaagaaataacttgtgttactaattgnatacccatatctgtgcaatggaatataaatatcacaaagtggt

SEQ ID NO: 17439 - DNA, 315 bp, Homo sapiens
  misc_feature 127, 130: n = A,T,C or G
atgttgggccagagcatccggaggttcacaacctctgtggtccgtaggagccactatgaggagggccctgggaagaatttgccattttcagtggaaaacaagagggcgttactagctaagatgtgtntgnactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgaccg

SEQ ID NO: 17440 - DNA, 178 bp, Homo sapiens
aatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataagggaaatgtgccatac

SEQ ID NO: 17441 - DNA, 250 bp, Homo sapiens
tcccgagttgaaaaaattgatggacaagaagtatcattgaaattaaatgggggcagacatgtccaaggaatattgcggggatttgatccctttatgaaccttgtgatagatgaatgtgtggagatggcgactagtggacaacagaacaatattggaatggtggtaatcgaggaaatagtatcatcatgttagaagccttggaacgagtataaataatggctgtcagcagagaacccatgtcctctctcca

SEQ ID NO: 17442 - DNA, 142 bp, Homo sapiens
  misc_feature 18, 75: n = A,T,C or G
atttgtaacattgttaangcactaagtgatttaaatccaattgatgaagatgtgattttacagaagcagaagttncattttcttgaggcttaaaaccaatgtcaccacttgggcttaactgggtaatttgtggttctaggcc

SEQ ID NO: 17443 - DNA, 324 bp, Homo sapiens
  misc_feature 174, 240, 263, 265, 272, 289: n = A,T,C or G
ccatccaagcaagagctacactgactaccgagttggaacagcattgccagggaaattcaaaattgtgctagattcagatgcagcggtatatggagggcatcagagactggaccacagcactgactttttttctgaggcttttgaacataatgggcgtccctattctcttttggngtacattccaagcagagtggccctcatccttcagaatgtggatctgccgaattgaagagcctgatntcagctccaccagatgcagattngngttttgntttcttggtatcactgncacacagcttataacatgtatgcttttcagaatac

SEQ ID NO: 17444 - DNA, 135 bp, Homo sapiens
  misc_feature 84: n = A,T,C or G
taattgcttacattatattttatatgggagattggatgtgtccatttaatacatgttaaaagctataatgtggactgtggaaancatgattgaaggagcaatttcattagaaataaatgtcattaatgactctag

SEQ ID NO: 17445 - DNA, 448 bp, Homo sapiens
gagtaagacttgtatatttctcatcactgctctttcaacttctagcacagcacctgacatgtaataaatattcaagtatctgatgattgagtattgtatcacaaggtgcttccattttcctcggttaaatgagctgtatttacactcaatttctgttcgctaatgtaaaaaagattaggtaagtctacagtaacactttatgctccttgttagtaattgtcagaagcagattatcaatacaaactataacaaatatgttaaaaaatctcactctaacataccaaaatatacgtacttacacagcgtaggattgaaattaaatttcagctatacgcatatttaagtttttgaaatgcatgaaaaaaagataatcttagttttaatccaaaaccaatggctttaagacaaagactgtaaaggaaaaaaaaaaaaaaaaaaaaaaaaaaaa

SEQ ID NO: 17446 - DNA, 341 bp, Homo sapiens
aagtggtaccatgggaaaactgggagagtcgtacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaa

SEQ ID NO: 17447 - DNA, 112 bp, Homo sapiens
gccttctcttgatggggccgagattgcactgggccgcggcggacgagatgctgtcggtttgattgataggagagtaaggcggctacttaaaacatatagtcaataggctact

SEQ ID NO: 17448 - DNA, 278 bp, Homo sapiens
  misc_feature 7, 15, 45, 74, 164, 170, 172, 174, 175, 183, 185, 205, 210,211, 230, 246, 248, 254, 262: n = A,T,C or G
accgggnggggcganatgccctgctacctagtttgttagtgcatnggagcacacattttaattttcctctaatnaaaatgtgcagtattttcagcgtcaaatatatttaactatttagagaatgatttccacctttatgttttaatatcctaggcatctgctgnaataanantnnaagaaaangnttggaatttaagaaataacntgtgnnactaatttgtataacccanatctgtgcaatggaananaaatancacaaagntgtttaactagactgc

SEQ ID NO: 17449 - DNA, 407 bp, Homo sapiens
  misc_feature 235, 375, 378, 397: n = A,T,C or G
aatagcttgaacctgggaggcagaggttgtggtgagccaagatcacgccactgcactccagcctgggtgacagagcaagactccatctcaagaaaaaaataaataaataataatttgtgtatgtgatgactgactctagtcattatggaaaataacttttggcagtttagttcctacttgttaacaattcctctttttaagagaggtactacatttgatttctcaatttctcagnttggtttcaatacaaacagcaccactgaaatgcagaaaatggtaatcaagggtgatgttctataaaaataattgagattcacatgtaatagaccctttagctttaatgagcagacatgagaatggttatgatcttaagtnggnaacataggaatatgtattngcaatttagt

SEQ ID NO: 17450 - DNA, 173 bp, Homo sapiens
tcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccat

SEQ ID NO: 17451 - DNA, 375 bp, Homo sapiens
  misc_feature 100, 310: n = A,T,C or G
atttcaccaccaaatgccaagaaaagggctgacattttctttcatgggcaccaacctgcatttgtatgtgtcccgaatccacagtcgtactgattctaanggggacacagatcatggtagagaatctctccctcctcagtaaatgtacaactgcacctgttatcatggaggtcatacatggatacaaagaggtgtacagggtaccatcttgtatacacatatatacccacatgtacaggacatacatttatgcacattcacgctgtttgtttcatatatacaggcataaaatagagtaaatacaggtagntttaaaagtacccttttgtgtgaattgactaccgtggttgcaaacccgaaaataaaagacgttca

SEQ ID NO: 17452 - DNA, 198 bp, Homo sapiens
tttctggcctggaggctatccagcgtactccaaagattcaggtttactcacgtcatccagcagagaatggaaagtcaaatttcctgaattgctatgtgtctgggtttcatccatccgacatttgaagttgacttactgaagaatggagagagaattgaaaaagtggagcattcagacttgtctttcaagcaaggactg

SEQ ID NO: 17453 - DNA, 123 bp, Homo sapiens
atactaatgcatatctggggcttaaaacctagatgacagggtgataggtgcagcaaactaccatggcacatgtatacctatgtaacaaacctgcacgttctgcacatgtatcccagaacttac

SEQ ID NO: 17454 - DNA, 427 bp, Homo sapiens
  misc_feature 220, 365, 416: n = A,T,C or G
gtgaatctggttacacatatggaaggaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagactnattatgtggggtcaaattgagtggaataaagtatagattaaaagtatacaatccttagccgttatctcaggcttatgaaatgtaattaaatttattaagaaaatagatgaaaaattagggacacagctggccaccaaatgcgagncaatctgctacttacccctgaaaacaaaatcagttttgcatataccactancctaatacatt

SEQ ID NO: 17455 - DNA, 180 bp, Homo sapiens
tttgaaagatagagattaatacaactacttaaaaaatatagtcaataggttactaagatattgcttagcgttaagtttttaacgtaattttaatagcttaagattttaagagaaaatatgaagacttaagaagagtagcatgagggaaggaaaagataaaaggtttctaaaacatgacgg

SEQ ID NO: 17456 - DNA, 178 bp, Homo sapiens
tcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtatt

SEQ ID NO: 17457 - DNA, 233 bp, Homo sapiens
  misc_feature 31, 69, 70, 196, 199: n = A,T,C or G
gaaaattcattcccctgaaatatttaggtgnctatattctatattttgatctattaagggattagtatnnttccatgtttattgtgttatcagagtgcattagaaagattagtgattcatcttcacagcacatttttaatcaagcagttatttcaaccagcacattcgtttgttcatattcactatagaatgatanctngtaaataaagacattcagcacactgtgaaaatgt

SEQ ID NO: 17458 - DNA, 193 bp, Homo sapiens
  misc_feature 158: n = A,T,C or G
tgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatnagtgggcccaaacgaagatctgggccaattaagcc

SEQ ID NO: 17459 - DNA, 200 bp, Homo sapiens
tggacaggatgcaggcagattttaagtgctgtggggctgctaactacacagattgggagaaaatcccttccatgtcgaagaaccgagtccccgactcctgctgcattaatgttacttgtgggctgtgggattaatttcaacgagaaggcgatccataagggagggcttgtgtggaagaagattgggggctgggctgagga

SEQ ID NO: 17460 - DNA, 293 bp, Homo sapiens
  misc_feature 39, 51, 122, 134, 143, 286: n = A,T,C or G
aacgagcgggccgacatgttctacttgtcaaattgatgngcaaaacctttnactggttgcatggaaatcagccaagttttataatccttaaatcttaatgttcctcaaagcttggattaaanacatatggatgntactctctngcaccaaattatcttgatacattcaaatttgtctggttaaaaaataggtggtagatattgaggccaagaatattgcaaaatacatgaagcttcatgcacttaaagaagtatttttagaataagaatttgcatacttacctagngaaactt

SEQ ID NO: 17461 - DNA, 188 bp, Homo sapiens
tgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgtttaaagaag

SEQ ID NO: 17462 - DNA, 209 bp, Homo sapiens
  misc_feature 31, 107, 115, 155: n = A,T,C or G
taatattttagaaagctcatttttaatgaanaataaaagttaattatctttttgagctaacatgtgatttttaaaatcattttgactactgggtgtataaatgtgtntgtgtgcncatgtatttatagatgttctttaaggtacccttgaaaacnctacattatgtatgccacataatgacatttcaggcagtggtagactacatatat

SEQ ID NO: 17463 - DNA, 199 bp, Homo sapiens
  misc_feature 85: n = A,T,C or G
gatttctcaaagaactaaaaatagaattgccacctgagccagcagtcccattactgggtatatacccaaaggaaaataaattgtnctaccaaaaagacgtctgcactagtatgctcatcacagcaaagttatcagcctaggtgccctctaccagcagattggattagaagacaatctgggatccttttttgggagttca

SEQ ID NO: 17464 - DNA, 105 bp, Homo sapiens
  misc_feature 3, 24, 31, 39, 48, 53: n = A,T,C or G
ccntgcacaagccagatcgagtanaaagtanactggacngagggggcngacantgttgtgtgtgtatatatatatatatgcacagatatctaagccaatttaaag

SEQ ID NO: 17465 - DNA, 181 bp, Homo sapiens
  misc_feature 116: n = A,T,C or G
acctgcattttcatttattaaatctggcaacgcttgttggggggctcacctgaaactatgagacagtttgtcagtggatcaaattgattagtcgcagtggtattgggacaattagnaaatcatttgggaaataagtaagattaaaatctattcgtccaaatgtactgtgatactctcgatt

SEQ ID NO: 17466 - DNA, 220 bp, Homo sapiens
gaacaaaaatgagaattcagaatttttcactttctactataatggcaaagagaataactgacagagaagacttttcacaattattagacaaatcagaagatcagtgcaaagagccaaatagaagcactgtaggccgtaatgatgtgggtgaaattaataatataagtgaaatctcaagactgagtctttggatgatgacactctagatcttctcaaacac

SEQ ID NO: 17467 - DNA, 151 bp, Homo sapiens
  misc_feature 145: n = A,T,C or G
ttttgtgtaaatccagatgaactgtcattatagtactataaattagagatagtccataaagttgggttgaaggagattgaaaatatttcctttgattaaaagaaaataattaactaacttgggcttgcttgtgattgaagagggnagatta

SEQ ID NO: 17468 - DNA, 136 bp, Homo sapiens
  misc_feature 8, 14, 16: n = A,T,C or G
aaacaggnaatgananctatttacatggaagtttctttctcatgatgcggtggagaagcctcggccacttggttctgccagatgttcctgggggtactgtaaatgggaaggacaggcagagctaaacaaggtttat

SEQ ID NO: 17469 - DNA, 462 bp, Homo sapiens
  misc_feature 148, 260, 390: n = A,T,C or G
ccagaaactcattgaagtggacgatgaacgcaaacttcgtactttctatgagaagcgtatggccacagaagttgctgctgacgctctgggtgaagaatggaagggttatgtggtccgaatcagtggtgggaaccgacaaacaaggttnccccatgaagcagggtgtcttgacccatggccgtgtccgcctgctactgagtaaggggcattcctgttacagaccaaggagaactggagaaagaaagagaaaatcagttcgnggtgcattgtggatgcaaatctgagcgtctcaacttgggtattggaaaaaaaggagagaaggatattcctggctgactgatactacggtgcctcgccgcctggccccaaaagagctagcagaatccgcanacttttcaatctctctaaagaagatgatgtccgccaagtatgttgtaagaaagccccttaaataaaggaagg

SEQ ID NO: 17470 - DNA, 202 bp, Homo sapiens
  misc_feature 15, 25, 59, 66: n = A,T,C or G
ggctcacacctgtanccccagcacnttgggaggccaagccgggcatgattacctgaggncaggagntcgagaccagcttggccaacatggcgaaaccccgtctctactaaaaatacaaaaattagccaggcttgggggcgcacgcctgtagtcccagctcctcaggagcttgaggtaggagaatcacttgaacccaggaggc

SEQ ID NO: 17471 - DNA, 192 bp, Homo sapiens
  misc_feature 164: n = A,T,C or G
tatttttcctccttaccttccaggtggccaagagcatgcttctttgattaaagcgtgcagtgagccaagtatccctctgtaactgttattagccatcccttaaagtacattttgtacctaatttttgcacaccaaggctaacagctctcccataatgcaggagnaatttctggatacccccaaaacttggag

SEQ ID NO: 17472 - DNA, 146 bp, Homo sapiens
ctttatcttggggagcaaaagctgacttttaaacttgacccctgctgtttttaaacagcttttccttttggtctctgacagtcaatccaggttttatgttatttcaaaagggttattttttgtcctccttttttaatagcttcagg

SEQ ID NO: 17473 - DNA, 276 bp, Homo sapiens
agctagggctaggcacagtggctcatgcctataatctcagcacttttgggaggccaagacaggaggatcacttcaggccaggagttcaagatcaaccaacctgggtaacatggccagaccccatctctatttatatatatatatatataaaacttagagtttttatcttcccctaaaagaggccgtgatatttgcagcagcctcaaattgctcttaaggggtttaggtgtgcagaagctttcctttccctacccagtaaccatgtgactactagcg

SEQ ID NO: 17474 - DNA, 611 bp, Homo sapiens
ggggaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgatgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatggtaagatggcccttgacattgagattgccacctacaggaagccgctggaaggcgaggagagcaggatttctctgcctcttccaaacttttcctcctgacctga

SEQ ID NO: 17475 - DNA, 157 bp, Homo sapiens
gacctggaaagaaagaattcaatgaatgaaattttaaaaattcatacaagagcttcaacaatagatcaaacaaaagcaaaaatctcagaacctgaagacaagtcttttgaaattgcccagtcagattttttgaaaaaaaaaaaaaaaaaaaaaaaaa

SEQ ID NO: 17476 - DNA, 373 bp, Homo sapiens
gtaagaagtgattagagacctagtttatgcataagcaattccttagtgtccaattaggttttattggcatgaaaaagaaatattaaaaaacctaatatttatagaactccaaatctcctagaattggataatgtattttctagtaagaaaactatagaaattttaaatatatatatttcctgtagtatcaagactctggctgacattgagagaaatatatgtacatgttgtgtttattttcagttttggtgttggattcctggtattgtcacctaagtgctcattttcaggaaaatcagattctacaataaacacttactgcttaaagttcagtaaacttgtgataacctcataacctctgtagtctaaaagg

SEQ ID NO: 17477 - DNA, 450 bp, Homo sapiens
cagcatgcttcgctgccccttagcaacttaggtggttgatttgaaactgcgaaggcgggagacatgcaggagctggaagtcttagaaaagccttgtaaatgcctatattgtggcttttaacgtatttaagggaccacttaagacgagattagatggctcttctggatttgtcctcatttgcacaggtgtcttgggattgaaaatcatgagcgaagtgaaattgcattgaatttcaagggaatttagtatgtaaatcgtgccttagaaacacatctgtggctttctgggttggggcgatattaataatgcaaaattttggctatctaggatcttcaaattggaggctttggacaccaaataaccttttggggcactggaaaattaatatttggaagcagaaccatgtacctttgctaaggtagaatgaaaaattaatggattttaaattgg

SEQ ID NO: 17478 - DNA, 165 bp, Homo sapiens
gagcatctgtagtttagctacttgggatgctgaggcgggaagatcactatttgagttcagtagttcaaagtgacagtgagctatgattgtgtcactgccttcctgcctgggcaacaaagcaagaccatgtctctctcttaaaaaaaaaaaaaaaaaaaaaaaaaa

SEQ ID NO: 17479 - DNA, 297 bp, Homo sapiens
agggaccgagaccgcgggcgggacctgaggtctaggcgcaccttcgattggcaggaagtagggcagggccttaggtggaaagaagtttggaaaccctggggagaaattaggtaaaaagaagtggaatcttgatgagctgcctaaatttgagaagaatttttatcaaagagcaccctgatttggctaggcgcacagcacaagaggtggaacatacagaaagaagcggtctacccgaaccagagacaagaaaatgaagaaaaagaaaaagaggaaaaagagaacaagataaaggggaaa

SEQ ID NO: 17480 - DNA, 519 bp, Homo sapiens
cttagacatatagtttctctgttttgctgcatatgtaagagaagaaagaaagataagacttccgatggaccaaaacttttcttaacagaagaagatcaaaagaaacttcatgattttgaagagcagtgtgttgaaatgtacttcaatgaaaaagatgacaaatttcattctgggagtgaagagagaatttgtgtcacttttgaaagagtggaacagatgtgcattcagattaaagaagttggagatcgtgtcaactacataaaaagatcattacaatcattagattctcaaattggccatttgcaagatctttcagccctgcggtagatacattaaaaacactcactgcccagaaagcgtcggaagctagcaaagttcataatgaaatcacacgagaactgagcatttccaaacacttggctcaaaaccttattgatgatggtcctgtaagactttctgtatggaaaaagcatggtggtgtaaatacacttagctcctctcttcctcaaggtgatcttg

SEQ ID NO: 17481 - DNA, 545 bp, Homo sapiens
ggtggcccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatgggggctttccagggaatgaagaagctctcctacatccgcattgcttgataccaatatcaccagcattcctcaaggtcttcctccttcccttacggaattacatcttgatggcaacaaaatcagcaggagttgatgcagctagcctgaaaggac

SEQ ID NO: 17482 - DNA, 570 bp, Homo sapiens
aatttaaatgaacactaaatttcatcaaaattggtggaaaacactctggaaaaactatggaaaacacttagaatgtcgcctgtacagagtaagcattacatagagctagtagtagtagtagtagaaaattaacactttaatattgttttgataatataataactcctgaattcctatatgtgtttctatttatttgtacttcctttgaaaaattgtgatttctattcttcccatcaaatattacaaaaagaaagtatgtattttatatttggccatgtctaacatatgtcaaacagctaaaattgattcaacttttagcagaattttattggaaatgttatcctttgttttcataagaaaaaatactaaatttaattaatgattaaattgacctaggacatataggcaagtgataatgctagtaaactttctactttccttgctatctcagttgtaaaaactaaaataacctcgtatctgatgctccatcctatattagacataatgggagagatctattgtgacatataaccctttttgccacttgccttaggactcattatgaaagtg

SEQ ID NO: 17483 - DNA, 267 bp, Homo sapiens
tacttaataaacaatttaggacagtgatgtctgcttacatgtgttatttggctgttaaaactaggctgcagatgtttcttgaatgctttgtcaaattaagaaagttaaagtgcaataatgtttgaagacaataagtgggggtgtatcttgtttctaataagataaacttttttgctttgctttatcttattagggagttgtatgtcagggtataaaacatactgtgtggtataacaggcttaataaattctttaaaaggagagacca

SEQ ID NO: 17484 - DNA, 533 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggtataataatggtagcatggacatg

SEQ ID NO: 17485 - DNA, 410 bp, Homo sapiens
cggatgcctagcttgtagtcgacttgagctgctgatgtgcacgatgcgaacgacgctgtttctgggaaagcagttttgctaaaagctggacagactttttcttttgtacctagcaggactttatatagtatagctttgggccatgtagcattttaagactcaattttaaaaaattattaatctggtgctgactcttaattcctatttcaatatgggttccttgaagaatcaggatacaacttcttggggatgacaagctttccttcacacactatttttggggggggggatatatctgaattgggaagaatttaaaaaacacataagctttttaatttggtttgaaacagacttctgcctgtacattttgcttttaaccaataaagaagccaatggcatttaggttatat

SEQ ID NO: 17486 - DNA, 252 bp, Homo sapiens
gcgagtctgcacgtgagaaaaccgtttggcttggcttggacccctgccgcccccacctcctccacacacacccagtccaggggtcccctttatcaccctttgcttgcaactccaaaagaagttgcccacctcctgagtcacaacacaaggtcgaataattcctctagatgaaagatcagtttcatttcaaaacgagaataggttcctttttttattttctccacatggtacaaaataaacagaatttgcttt

SEQ ID NO: 17487 - DNA, 520 bp, Homo sapiens
aggacttatttaagggtctctcgctcttggctgatgaacctgtgacagatatccaacttttgggcaaataattcgtaatgggaataaaaaaagaaatagggattttacatgagaacagccttaaatcattcctagagactatcttaaaatagaagcactgagatgacattctttccacacaggcattgcatcctgctctatctgccatcacctgtttgggcactgccaaatagaacactgtaataatttaaaagtagtaaaaagtgtatctttatcaggtaaaggatcaaaagacagggcaaaataaggtgggtaaaagtgccacccttgggagagacttgagttggacaggtttagtatgctctatatgttaaggaattttttaaagctcatatggaaaaataagaccggtaggaaaaactgttaaaaaaaaaaaggtggccgggggaggaatgagggaggccaatgcactggattaaacctaagcccggggaattaaaacaaggggggccagggcctg

SEQ ID NO: 17488 - DNA, 527 bp, Homo sapiens
ataagaaaaataggcaaagtatataaagaggaggtaactaagggaaagacataaaaattggccaataaacattttaagagatgctcaatctcaccgtgatcagggaagatataagacaaagccatgacttttttgtctacaaaatttagaagttttctaatatcaactattggcagagaggtagtggaatgaatactcttaccatgctaatataatagaaatttccccctttcgaggacaatttagcacagtttagtaataacaaaagtgtatgccatgttatatagcaaatctctttttatctaccctcgggaaaggagtacaatgtgctcaagaaagcatataaaaggaattttttttgcatcagtgcgatggtagcaaaactagaaagaacctgtttttgttagtaggagtatggctcaataatctatggtaaatggataataagggaatactatgaataactatgtgaccacaaattagataacttagatgatatatatctctagaaaacccaaactaaactg

SEQ ID NO: 17489 - DNA, 571 bp, Homo sapiens
gcagcggtgaaagcaccatgatcatagaggaagttgtaaggaaaaaatgggcaggagagcaaagaggagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaaggggaaaaagaaattctggtaatggtaattaaagtaaaattattccctgaattgttgatattggcacctagcagatatgtattacttttctgcaatgtattattgcttgcctttgtgagattctatgaaaaatatatatgttataaaatatatatgcataggcagacttaggagtttggttagagcagtaacatctgaagggctaatgcataacttttggaaggactgaatacctaatatgggggaacccttttgcggggccctaggctacaatgggcccggaacggttcatggaagatcccaaggggcaccataacaggctttgaaaaagccggaccttaaatttc

SEQ ID NO: 17490 - DNA, 259 bp, Homo sapiens
gggaaactgaaagactaatcaaaagcaagaacaagctaagattaaaccttgtaccttttgcataatgaactaactagaaaacttctaactaaaagaattacagctagaaaccccgaaaccaaacgagctacctaaaaacaattttatgaatcaactcgtctatgtggcaaaatagtgagaagatttttaggtagaggtgaaaagcctaacgagcttggtgatagctggttacccaaaaaaaaaaaaaaaaaaaaaaaaa

SEQ ID NO: 17491 - DNA, 591 bp, Homo sapiens
gaacttgcggccggatgcattagcaatgctcatgtgcaaagttataggttctaggggcgatagacatgtattctggaaatgaagacactgagacttaaattgattacagttgccctgttcctccatccacagtatcctcgagggattggtccaggatccccgaggataccaaaattcatggatgctcaagtcccttatatgaaatggcttagtattttcatataacctatgcacacccccctgtatactgtaaatcatctctaggttacttataatacctaatacaatgtaaatgctgggtaaatagttgttatactgtagtgttaagttgtattggtgtattgctattttttactgggctctcctcaaatattttgatccacagggggttgattctatggatgctgaatccacggatgttgagggatgctgtatataatttgccatgtcacatagctggcagggccaaggctgggatttgaacccagggtaggcctgactacaaagatcccatgacctgcaaagatccaaagaactggtttacacaccgggacccagttaatggcaccggatcaaaaccccaaggaggaa

SEQ ID NO: 17492 - DNA, 558 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaaggtgacttaaacagcttaaagtttagtttaaaagttgtaggtgattaaaataatttgaaggcgatcttttaaaaagagattaaaccgagggtgattaaaagaccttgaaatccatgacgcagggagaattgcgtcatttaaagcctagttaacgcatttactaaacgcagacgaaaatgg

SEQ ID NO: 17493 - DNA, 556 bp, Homo sapiens
  misc_feature 2, 9, 10, 11, 12, 13, 14, 15, 20, 21, 22, 30, 33, 37, 46,47, 53, 58: n = A,T,C or G
gncgggggnnnnnnnggggnnnatccaaangangacnccggccatnntgggcnatagncccgacccaggtgagagctcgtctttctttctgaagccctttgcttttggaggaagccctccagcttcggctgaactggcagcttctccaagcatcaccctgggagtttcctgagggttttctcataaatgagggctgcacattgcctgttctgcttcgaagtattcaataccgctcagtattctaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgaccttggtactgggatattttaaatatccacagtactcactttttccaaatgatcctaggaattgcctagaaatatcttctcttacctgtatttatcaattttcccagatttttatacggaaaaaattggatggaaacacttag

SEQ ID NO: 17494 - DNA, 499 bp, Homo sapiens
gcgagccagcatgacccccggggccattctgatcatcctcactggaccgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgcacagaaaaagagaaatatgagattacggagcagcgcaagattgatcagaaagctgtggactcacaaattttaccaaaaatcaaagctattcctcagctccagggcgacctgcgatctgtggttggtctgacgaatggaatttatcctcacaaatggtgttctaaatgcttaagaacctaattaaatagctgacgggaaaaaaaaaaaaaaaaaaaa

SEQ ID NO: 17495 - DNA, 434 bp, Homo sapiens
aaaccatgaagagcctgatccttcttgccatcctggccgccttagcggcagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtata

SEQ ID NO: 17496 - DNA, 469 bp, Homo sapiens
gaatttgccatgtactggataacgtttcattcgatatgagaaaggctcaccagaacccgggctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggttattattgccagttttggcctcctcagtgccctcacactctgctacatgatcatcagagccacagctagcttgaatgctaatgaggtagaatggttttgaagaagaaaaaacctgctttctgctgattttgccttgaaggaaaaaagacctatttttgtgcatcatttaccaatcatgccacacaagcatttattttaggacatttgattttttcataaaattgctaatgccaaagctttggattaaaaggaaat

SEQ ID NO: 17497 - DNA, 391 bp, Homo sapiens
gcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtgcttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattcc

SEQ ID NO: 17498 - DNA, 221 bp, Homo sapiens
acaatctcttcctgaagttatacctatgtagaactttctagaaagaacaagttacccattcttaaagctccaaattcaggccaggcatggtgcctcatgccgtaatctcagcaccttgggagactgaggcgggaggactgcttgaacccagaagcagacatgcctgggcgacaaagtgagaccatatcactaacaaaaaaaaaaaaaaaaaaaaaaaaaaa

SEQ ID NO: 17499 - DNA, 590 bp, Homo sapiens
ctaaggtagagttaggggatctctagtttaggttaggtgtcaaaactataatctttaacaaatgggaaaaatgaaatagggtgttgtccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgcactgattgtggcaacagctttgctcatgagcaaaaattggcaatttcttttgattttaagtggtgaattggctgttcaagcatttgtacatattagaagctaaggagaagcaagcagtgggaggactttttcacccctggattagcagcttcgcctcatttccagatgcccagtcctattaataagtagcaaggaaggggttgcacggcaggacagggaggcaggacagggattctgctccttctactttaccaccggacacaggtggccttgcttgcccccaaaggattttggggctggggcaaatggggctttcttccctgggccttaacctgggtttaaaaaaga

SEQ ID NO: 17500 - DNA, 476 bp, Homo sapiens
aatttgaccaaagtattttacccaaagcagactaagtatagagagcaccaagtaggctttgcagtcctggacatgatgaagaaagatggttaaagagaggtaacacaacctacattttataacagaaaattattgaaatagcgaagttcattgactcttggtggggataataaagagctacagaattaaagttctgggccgggtgtggtgcctcacgcctgtaatcccggcactttgggaggccaaggcaggcagatcacatgaggccaggagttcaagaccagcatggccaaaatggtgaaatcccatctctagtcaaaatacaaaaattagccggacgtcatggtacatgcctgtagtcccagctactcaggacgctgaggcaagaattgcttgaactcgggaaaccaaggttacagtgagccaaggttgcgccacgcactccagcctgggtgacagagtgagactctgtctcc

SEQ ID NO: 17501 - DNA, 504 bp, Homo sapiens
gacataaaagctttgaaggacaagggcattaaaggagaggaaatagttcagcagttaattgaaaatagtacaacattccgagacaagacagaatttgcccaagataaatatattaaaattacaaatgaaagagaagccattacagctgatacaacagaaatacaaatgagataataagagactacaatgaataactatacacaaacagatggatagcctagaagaaatagaaatttttttctagaagcatagcgtctaccaatcatgaagaaagagaaaatccaatcacacccagtgactgtaaggagactgaatcagtaatcaagaacctcccaaaaaagaaaagctttggacctgaaggctccactggtgaattccaacaaacctttaaagaagacatagcacaagtcctaaaactcttccaaaaccttagaggagggaatacttccaaactcattttacaagtctggtgttgctgtgataccaaagccaaacaaggcccct

SEQ ID NO: 17502 - DNA, 510 bp, Homo sapiens
ttaagtatgcgtagaatggatatagcctctgctcctatgaggggtgctaaaccctgggacatggtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgcatcaggaatcaaaacccacagtccattgtgaagtgtgctatatttaggaacagcttaaaatgtacagtgtattttatagaattgaagttaacattcttattttcaagagaatttatggacgtggaagaaatgtacaaatgcatttccaaactgccttaaacggtggatttttatagacatggttttttaaaaatcctaagtttttaaataactatggattggggatttttttgggaattgggttattaaaaccatggcctcagtaaagaggtttaa

SEQ ID NO: 17503 - DNA, 548 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgcca

SEQ ID NO: 17504 - DNA, 308 bp, Homo sapiens
caaaactctgcttcagcaagatgtgaaaaaaagaagaagctatggaaactcatctgattccagatatgatgatggaagagggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatga

SEQ ID NO: 17505 - DNA, 412 bp, Homo sapiens
ttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgatgaggacaactctctttttccaacaagagagccaagaagccatttttttccatttgatctgttccaatgtgtccatttggatgtcagtgctattcacgagt

SEQ ID NO: 17506 - DNA, 465 bp, Homo sapiens
aggcctgctgagcgaacatagcctttctgaaattcaccaggatggagtctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagctgagaatattggcctttctaacctatgtgcataattaaaaccagcttcatttggtgctccgagagtgttctccaagggtttctatcttcaaaaccaactaagttatgaaagtagagagactgcctgggtatccagtatgagataaaaaatgaatataagaggcttgcattataaaagttcctttttattctctcaagccaccagtgcagcaccagcagccagctggcagctagcttttttttttttttttt

SEQ ID NO: 17507 - DNA, 472 bp, Homo sapiens
ttattaaaagggaatcgtggggctggacagactttctaatgaacccaatggttatgatgatggccttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgccagagctggcatttgcacaaacacggcaacactgggtggcatccaagtcttggaaaaccgtgtgaagcaactactataaacttgagtcatcccgacgttgatctcttacaactgtgtatgttaactttttagcacatgtttgtacttgtacacgagaaaacccagcttcatctttgtctg

SEQ ID NO: 17508 - DNA, 289 bp, Homo sapiens
ggagcattaactaaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctggatttctttgtagaataaatgggttctcattaaactct

SEQ ID NO: 17509 - DNA, 222 bp, Homo sapiens
atttcctacagatatgcttagttcttgcgctggttgtatttctggtgcaaggactgaatttgcgagagaaacatggatagtataaagttgttagttttagcatatcctagaaatcagagtggaaagattaaatgtaacatatcccaaaaatctatatgaaaaggagttaggattgcaaaggattattttatttataaagagagattgaaaggaaaaaaaaag

SEQ ID NO: 17510 - DNA, 313 bp, Homo sapiens
acagccgtttgacttcaacgcatggacaatttcatcaaaggcaaatatttaaaaaaaccatgggtggttcagtctaacataagagagggaattattcatcaagaagaggccctttagcaggggatttaaagtgccaggtacttacaataacaaggtggactgaacacattgtatctcaggaattaaagaatttttcctaaaagaaggctgagatcatgcacatctgagatggggtaggttgaaattccacacagtcttcaattgccaaggttggatgggatgaacataatacgagaaaaaaaaaaaaaaaaaa

SEQ ID NO: 17511 - DNA, 539 bp, Homo sapiens
cgtatgttaactacctgatttggctggaaacacagattgtatactatgagtccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggcaagattactaatatttgggaaggctttaaagacgcatgttatggggctaatgtactttcacttttaaactctagatcagaattgttgacttgcattcagaacataaatgcacaaaatctgacatgtctcccatcagaaagattcattggcatgccacaggggattctcctccttcatcctggaaagggcaacaataaaaaccaaattatggggctgctttggcacactagcatagagaatgggtggaaattaaccttgtaagcctggatgggggtggtggacctttttttccttacag

SEQ ID NO: 17512 - DNA, 489 bp, Homo sapiens
tatggagcaatttcttatcaagtgggttggctgattccattcttctgttaccgactttttgacttcgtcctcagttgcctgggggctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgaccctgcctttgagcacctcctcagtacgttttgccaacctatgaaatggcgtgaaaatgcctgaaaaagaccaccacctccttacttacctgcctgaagaaattctgcctttgacaataaatcctataccagctttttgtttgtttatgtacagaatgctgcaattcagggctcttcaaact

SEQ ID NO: 17513 - DNA, 292 bp, Homo sapiens
agagattagggctggcatgcatctctggggaaccatgacaggttcacatgagaagcagcttggtgccctgccccatgggctccttgtatctgggactcagccctcatcactggggttctcagcctcagcaaggcagctttcacggatatccagattccaggctgggtgcagtggctcacacctgtaatcccagaactttgggaggccaaggcaggtagattgcttgagcccaggagtttgagatcagcttgcgtaatatggcaaaaccctgtctctaccaaaaaaaaaaaaa

SEQ ID NO: 17514 - DNA, 383 bp, Homo sapiens
aaactagagatggacaggctatcaacgaatcttgttagcattacgatgaccttgaataaaaattgcacacactcagtgcatgcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaagggtattttgaataccattaaaactgcttttttttttccagcaagtatccaaccaacttgtttctgcttcaataaatctttgaaaaaaaaaa

SEQ ID NO: 17515 - DNA, 500 bp, Homo sapiens
  misc_feature 203: n = A,T,C or G
attatgtactaattaatattagagacacatacctgaacatgaaaaaatttaaactagagtgttgacatttaaagacagatctgtggtgtatcaagtagccacaatatttctgtgtaagatgtagtgggaaggaggagtggatttgcagataagggaaacagaagtgccaatcagtaaacattcattgatcttacaattaatgngatgcctaattaaaatgggttgctagcttttattaattacctagaaaatatttgaaatttttttcggctttaatttctcttacatttcatttatattcctatttattttctgaggtggcttgaaaatttgacttgaatttccttaaattttcttaaccaaatctaaaagtaaacagctgcaggtgctggccttggtgggggggggttctcttttatcagcagagaatgtctaagcctctgccaggagtctgactgcaaaggctttggggggaaagggggggagaatgggactaaggc

SEQ ID NO: 17516 - DNA, 330 bp, Homo sapiens
aatatccatgacgcagggagaattgcgttatttaaagcctagttaacgcatttactaaacgcagacgaaaatggaaagattaattgggagtggtaggatgaaacaattcggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacgaacttagaagaaaattggaagatagaa

SEQ ID NO: 17517 - DNA, 273 bp, Homo sapiens
ttgctggatgataatattccttagtttcgctgaggctaagttgtgggtttgcaatcaggccgagtggtttgaggacgatgcatacagcgcaagagggagctggggccacctgagaagcttcgagagatagaggaattcaaagagaggttacggaagcggcgggaggagaagctccttcgcgacgcccagcagaactcctgaggcctccaagtgggagcctagcccctccctgatgaaatatacatatactcagttccttgtaaaaaaaaaaaa

SEQ ID NO: 17518 - DNA, 323 bp, Homo sapiens
aaaaactcctattttcagtatctgtagcacctgaaataggtctttgtatagccagacacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagacggactagttaatcaagatttgttgtcacttaaattttttgtgatttttttccaagccagttttttttaaattctaaatgtgttttgaggtatgggtacattaattg

SEQ ID NO: 17519 - DNA, 369 bp, Homo sapiens
  misc_feature 2, 9, 10, 11, 12, 13, 15, 20, 22, 27, 34, 45, 46, 52: n = A,T,C or G
gncgggggnnnnnangggantntccantggaagnctccggccaannctgggnattatcccgggaaaggcaagactgggacgtttagtccacaggaagacctgctccactgtcgccttcacacaggtgaactcgggagacaaaggcgctttggctaagctggtggaagctatcaggaccaattacaatgacaagatacgatgagatccgccgcactggggtggcaatgcctgggcctaagctgtggctcgtatcgccaagctcgaaaaggcaaaggctaaagaacttgccactaaactgggttaaatgtacactgttgagttttctgacataaaaataattgaaataatacaaattttccttcaaaaaaa

SEQ ID NO: 17520 - DNA, 165 bp, Homo sapiens
gatgcaatctgtgacagtcttatgaagcagggatgaagacataggatcaaaatgtttgcatagttattgaagctatgttgatattatgaaattatattgttacaagtttaagatgctaattataattctcaaggtaaccactaataaaattaccaaaattatgcc

SEQ ID NO: 17521 - DNA, 500 bp, Homo sapiens
ttgagattgcttgtttccacaagaaggaactgcaggattagtgggatgtgtagatattctactaaataatggtggtgactcagctaggttagtacgtggaagctgctgaagaacttcagaatgggtaacacagaagctaggaggacattcgcagatgatagtaggaaaggcttaattacagtctgctgatagccacaagataaagacctgcagaagtccccaacattcttttgatattttgaaatggcaggcaagagccagcggtcacagaagaatcataagtccccgaggaaagggttggaaaataaatataaaatttaactgtatcagaaaaattatgttggcctacctgtgatgaggataggagaaagattcattcgaggattggtttaaatttgggaaaggccaagctttaattaatgccagctaggaggttaggattaaagaagggtggaatttacctccatggcctggaccaccaaaaccaagatggaaataag

SEQ ID NO: 17522 - DNA, 409 bp, Homo sapiens
gggaccgcaaggttaagatggctaatgataaccttttgtatgtatagcagggctagcccctataccgggtgcataatgaattaactagaaataactgtgcaaggagagccaaagctaagacccccgaaaccagacgagctacctaagaacagctaaaagagcacaccccggctatgtagcaaaatagtgggaagattataggaagaggcgacaaacctccgagctggtgatagctggtgtcaaagatagaatcttaggtcaactttaaaattgccacagaccctctaaatcccttgaaatttaactgtagtccaagaggacagctctttggccctaggaaaaacctcgagagagagtaaaaattaacacccatagtaggcctaaagcagccaggaaaaaaaaaaaaaaa

SEQ ID NO: 17523 - DNA, 544 bp, Homo sapiens
gatttgcagataatgaagaatctctcctacatttgcatggctggataccaatatcaccagcattggtgaaggtcttcctccttccctaacggaattacatcttgatggcaacaaaatcagcagagttgatgcagctagcctgaaaggactgaataatttggctaagttgggattgagtttcaacagcatctctgctggtgacaatggctctctgggcaacacgcctcatctgagggagcttcacttggacaacaacaagcttaccagagtacctggggggctggcagagcataagtacatccaggttggctaccttcataacaacaatatctctgtaggtggatcaagggacttctgccacctggacacaacaccaaaaaggcttcttattcgggtgggagcttttcagcaacccgggccagactgggagatacagccatcaccttcagatgtggctacgtgcgcctgccattcaactcggaaactataagtaatctcaagaaagcccttattttatacctggaaaaacttgtaatggcattgc

SEQ ID NO: 17524 - DNA, 205 bp, Homo sapiens
caagagaggtggcagcattcagcagtatatttataaacaggaacctgtacagaagtgccctggaagaaggcctgctctaaattatccagtgtatggagaaacgacacagggttaggagacgtcgctttgaacgtgctataggaccttctcaaacacacaccatcagaattcaatattcacctgcagactggcttatcaagacaaa

SEQ ID NO: 17525 - DNA, 250 bp, Homo sapiens
cccatttttgacatcttggaatcttttgttggttacagtaatcacattttaatgactcagattgagcatttcatgcttgcatataggtcattatacaacagtttgtctataaacatatattaataccaaataatatttcaaaaagtcggccggcacagtggctcactcctgtaactaattgtgctctattataactttttaaaaattaacgaatacaaataaaatgctggcccaggatgctttttgttct

SEQ ID NO: 17526 - DNA, 126 bp, Homo sapiens
cacatcaacctaaagagaaccatctatggaaggtatggttgaaacatctgtaggaacacagaactgggatggcactgagcttaccaaatcaactgtgtgaactgtttctgcactgcttgctaatgg

SEQ ID NO: 17527 - DNA, 342 bp, Homo sapiens
ggaagactttaacattaaaacaattttggagttctgatcattatctattattgtacacttataattactatactcagactatatttgtgacttaacatgatcgtaggactttacccaagagtggccagaaaaaatatggggtctacctgagttttaatccaagggtaggagaaagattgtccacatcaaggatcttaagtaaaattatgggaaacaaaaataattgtttaaaatacctaatgctagatgacacgttagtgggtgcagcacaccagcatggcacatgtatacatatgtaactaacctgcacaatgtgcacatgtaccctaaaacttaaagtat

SEQ ID NO: 17528 - DNA, 497 bp, Homo sapiens
accctacgaatgtaaagaatgtggcaaagcttttatccaatcctcaggccttattatacacaggagcgttcattctgaacaaaaactttacaaatgtgaagaatgtgggcaaagcctttactcggccacagcctgaatgaacataagaaaattcattctggagagaaaccctacaaatgccaagaatgtggcaaaagcctataacttatcctcaacccttacgaacataagagaattcatactggagagaacccttcacatgtgaagaatgtggcaaagccttcaattggcctcatcccttactaaacataagataattcatactggagagaaatcctacaaatgtgaagaatgtggcaaagcttttaatcgggcctcacccttactgacacaagcgaattcatactggcaaggacatagttgaatgacatttctagtaatctctaattccaggggctttacacagaaataaattggggatattgctccaaaaaaaa

SEQ ID NO: 17529 - DNA, 144 bp, Homo sapiens
acacctgtccccctgcttcagggacgtccagatcggtgacatcgcacagtgggcgagtgccggcctctgagcaagacagtgcgcttcaacgtgctcaaggtcaccaaggctgccggcaccaagaagcagttccagaagttctga

SEQ ID NO: 17530 - DNA, 176 bp, Homo sapiens
gagctctggaaggagactgaaatcaccagggtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaaaa

SEQ ID NO: 17531 - DNA, 629 bp, Homo sapiens
atttattatatgtctctttgtggccaggcagcttgcttttcactggaaattggctagggagatgggggcggtgaaaaatacctctctccatggtggaggcatgcataaaagccgattgctacacaactgcgtaagaagtgctttaatcaaagcctgaataaagtgttgtggaaactcaaaggagcaagcaaaatgcttcacatgaaagttggcattcgagtcaaagactcacaggattttccaagccggaaagaaaggagaggccacatggacagagggaatagcatggtgcaaagcatggtatgaaaaaaatacatgacaaatttgtggaataacagaacttttgatgtgatcacagcataatgtggagttgggtaacagtgagggattaggctaaccagcttgcagaatactgactaaaaattcttaaatgctggctaaagtggtaagaatttatcttacaggttttgagaaccatctgcggtcacactagatgagtgacacaatcagatggcggatccaggtggtaaatgaacatccatgtaccatcaccctgggcaatacctatcccttcatgggggaaggtgggcaacttttcaaatggtaacaacaatggccaggccgggggt

SEQ ID NO: 17532 - DNA, 336 bp, Homo sapiens
tggacacatagatggtgatggcaaagggttagaacacatttttttcagagactaaatgtaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgaccaaaaaaaaaaaaaaaaaaaaaaaaaaaaaaa

SEQ ID NO: 17533 - DNA, 562 bp, Homo sapiens
atcgagacaggtaagcaggatcatggagggtttaagatgccgcatttggatcggatgaattccagattctgcttgcttgctttttaatattgatatgcttatacacttacactttatgcacaaaatgtagggttataataatgttaacatggcatgatcttctttataattctactttgagtgctggctccatggttgatgtatctgagcaggttgctccacaggtagctctaggaggctggcaacttagagggggggagcagagaattctcttatccaacatcaacatcttggcagatttgaactcttcaatctcttgcactcaaagcttggtaagataggtaagcggcataagtaacttccaatttacatactctgcttaagaattggggggaaaatttaggaaatataattgacaggatattggaaattggtataatgaatgaacatttggcatataagatcatattactcttatacatttgaaaagtaggcatggtgggggtaaactggttattttggccacaggttaataaacataaactggaaaaaaaaaaaaaaa

SEQ ID NO: 17534 - DNA, 627 bp, Homo sapiens
atcatttaaaatcaaaatcctttcatataggagtttaatcctttcttagaaaacaattgtctgaggagttttacaaactgaaaaagggaatagaacagtgtaataattctttttttctatcaaatcaagcaccagctccttcagtagaattccagtgtttctacattaatccaacttcaagtcttctttcagccatgataagtcaggattcattagaaattctccattacacccttttaggcttttgttaattgttctgtaattagtgcctacagtaagaaaaataggaaaggcaaactgtttgtccacaagcaaagaaccacaaagctgtttcagtctgcttagaaatgaacaattacctcgtttgatgatatccaatttcaagaagagcccataattctgggcgttctaccatgatttcaaatgatctcagcagataccagagaagcatctttcttgcagaaaacttgtcagttgaaatctggagatggttttgggaaatattaggccaactgagtgaacaaaaatgatgaagaatgtttttgggtttagctaacttctcttcaggaacacatcaggggaagtgttgagagaaggtcccatcatgtcggaaacagcatgaaaaag

SEQ ID NO: 17535 - DNA, 470 bp, Homo sapiens
agaaggaggaggaaatgcagtataaatggagacagagctcttgtgaatagagatctgggaagacaaatcttttaaatcttcttggataagtgggagttagacattgtactttcaaggatgttcatagaaaaaggaactaaaaattctggatttaggataagtagacttaccaattagttgatgcaaaaaaactacaagatcagcttggtggtggagatatgaaagttgttcagtgtttgggtcttaaagataagatactggggctgggcacggtggctcacgcctgtaatcccagcactttgggaggcagaggcaggaggatcatgaggcaggagtttgagaccagcctggcaacatagtgaaccacgtctctactaaaatacaaaaaaccaattagctagcgtggtggtggcacctgtacctcagctacttgggaggctgaaggcaggagaattgcttgaactctggag

SEQ ID NO: 17536 - DNA, 280 bp, Homo sapiens
actaacatttataccaaattgcagattattctgcagagagggaattgcatgtttgggtcgtatatttagtatgaactttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttaaaaaaaaaaaaaaaaaaaaaaaaaaaaa

SEQ ID NO: 17537 - DNA, 610 bp, Homo sapiens
gataagtttgtttctctttgaaagatagagattaatacagctacttaaaaaatatagtcaatagggtactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaaggtgtagggtgattaaaataatttgaaggcgatcttttaaaaagagattaaaccgaaggggattaaaagaccttgaaatccatgacgcagggagaattgcgcatttaaagcctagttaacgcatttactaaacgcagacgaaaatggaaagattaattggggagtgggaggatgaaccaatttggagaagatagaagtttgaaggggaaactggaagacagaagtccgggaggcgaagaaaggaattgagaggatggggaattt

SEQ ID NO: 17538 - DNA, 207 bp, Homo sapiens
gctgaaggctactgggccatcttcatgtgctgctggaagagctcctattttgtactcctggctagaatgctgtggaacaaatacaaagtgaaaaaagttctctgtagatttctgaagtgcatattcattgatgccaagaaaaaaaaaaagttgcctttttgaaaaaaaaaaaaaaaaaaaaaaaaaaaaaaaaaaaaaaaaaaaaaa

SEQ ID NO: 17539 - DNA, 248 bp, Homo sapiens
acagaattgaaagcaaatgcttagaagacttctggcagcaacttaaatattgcgaaagtaaagaaggaataatctaccctgactaaagcttgaaatgctacatttccaaggtgaagatgtgtgggcacatgttatggcagattgaaaaggatctcattccatgggaaaaaaaaatcctgtcttgttcataaattgacaatgtcaataaattgaaatatggttcactgttactctaaaaaaaaaaaaaa

SEQ ID NO: 17540 - DNA, 265 bp, Homo sapiens
gggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgttaaagacatttacttggtatttagtgacacatttccatccta

SEQ ID NO: 17541 - DNA, 257 bp, Homo sapiens
attgaggccgtgcgcatagagctagctcaagtctactgtccaccggacgatgcacacctcaaagaagtggggcttcaccaagttcaatgctgaggaattggaagacatggtggctgaaaagcggctcatcccagatggctgtggggtcaagtacatccccaatcgtggccctctggacaagtggcgggccctgcactcatgagggcttccaatgtgctgccccctcttaatactcaccaataaattctacttcctgc

SEQ ID NO: 17542 - DNA, 610 bp, Homo sapiens
gcggatggaaccatggagggtgtagaagagaagaagaatttggttgctgctgtgccaagaaacccttaagagggagcgaaggaatttcgcagagctgaagatcaagcgcctgagaaagaagtttgcccaaaagatgcttcgaaaggcaaggaggaagcttatctatgaaaaagcaaagcactatcactaggaatataggcagatgtacagaactgaaattcgaatggcgaggatggcaagaaaagctggcaacttctatgtacctgcagaacccaaattggcggtttgtcatcagaatcagaggtatcaatggagtgagcccaaaggtcgaaaggtggtgcagcttcttcgccttcgcaaatcttcaatggaacctttgtgaagctcaacaaggcttcgattaacatgctgaggattggagagccatatattgcatggggggaccccaatctgaagcagtaaatgaactaatctacaagcggggttattggcaaaatcaataagaagcgaattgctttgacaggaaaacgctttgatgctcgacctcttgggaaatacggcatcatctgcctggagggattggatcatgggaactttccgggtgggaaac

SEQ ID NO: 17543 - DNA, 197 bp, Homo sapiens
agcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctg

SEQ ID NO: 17544 - DNA, 250 bp, Homo sapiens
gctgcgaggcggcatcatcagaaacaagtcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggc

SEQ ID NO: 17545 - DNA, 599 bp, Homo sapiens
gcaggggtaatacttgacaacccccaggacttttctatggggacatgcggctgtactgctctgataccgtagatttagtgtccttgatatccccattgccaggattccaaatctttgccttcaaaggtatttattctcctcttgtgtgccagttccatagaggatgtataagatgtgaaaatgtgtggaggatatagattgatcaggaaggaggagaatcctttcaattatacggttccatggaattggattcttttttccaactaacatctatttaagaatgaaaagggaatgtggagaaataaggtggattaagatagtagaaataggctgggcgcggtgctcacgcctgtaatcccagcactttgggaggccgagcgggcggacacgagggcaggagatcgagaccatcctggctaacatggggaaccccgctctactaaaaatacaaaaattagctggccatgaaggcgggcacctgtggtccagctactaaggaggctgaggcaggagaatggggggaacccgggaggcggggtttcagggagccaaggaggcgccctatactccagcctgggggacagagcgagactcctttc

SEQ ID NO: 17546 - DNA, 530 bp, Homo sapiens
tctattgcatattaatttgacatccacatgctgaaaatgttattgctgagacttaatcagaatatgtgggaggtattttttttaaacttttgtactaagcagcttttgtatgcagtggtgactccgtgggaaaatattttagaggaatcttagttataaaggttattgctgcagataccgaattaacagtatttaataatttaattttttaagcacaaattaagaatagcataatgtatttgaccactgagccacataaagaatgtgctagttaatttgcccccgaagaatactttctaaaggctaaaatgatttacattgcattcaatggtcacaaaagggtcatattttactttataagaatagaatcaggacaatgaacatagtctccttgaatcaagaaaaatgaattaaagactgctatttctacttttttattagactgtgagttccctggcccacaagccaccttgcttggggctgtttgttccaatgcactttattcaagaacaatcagaccaacacttaat

SEQ ID NO: 17547 - DNA, 600 bp, Homo sapiens
gtggtatagtgcagatgactcctagtaagcacatatttggtggccttagcatacaagaatgtgaaagttgttttcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcctctataacaacactctgttcctggcgtggcattgttgcttccttcttcatattgaagaacttcaaccccacagtgaactacatattgccataagtgcttcatcaggactcatcgcctcctgctactggctccaaatagaccatgcaggttcaccccctgcttggggctatggggggcctgggtatatggaaaagtagcagggtggtcaaggggggagacacaagaggtttatagctaagagcctttaaaaacccagcagaaggaatcaggatttggttattggctggtttttgacagattggtgaaataaaagaattggaagggaacctcagggcctagggcggttattaaaaggaaaaaag

SEQ ID NO: 17548 - DNA, 310 bp, Homo sapiens
gaggatgagaacggatgctgctgcaccaacaaggagactttgtaccgagccagttcatagagctggaatggccaacctgaagctgaagaagccgcctggtagcacatgccgcggccatgactgtgaatgctctggtggggggagcttacttcctcatcaccggaggaataatttatgatggtattggtgaaccttcaagtggcgggctatgactgaggaacatggcatcaagaggcagtagctttcttggctacagaggaaatggcaatatattatggaaggcttgcatccagcttcctaattacaaagg

SEQ ID NO: 17549 - DNA, 303 bp, Homo sapiens
ttgaaaagctaattattttttccgcagctatttttcccattttttaaaatgcattctgaaaccaactggccctcaataagataactatagtaaccaggcaaagaaggaattatcttccaggtaccatagcaagaacatcttagagggcacatctattacaggcaacagaagccaaggcacaagctaaccattcgcatatttgctttaaatttatacttgtaatttgctttttcaaacaaacagatctggctcagagcattctagcacaaaaaaggtaaacattaatagttctgaaaattatcc

SEQ ID NO: 17550 - DNA, 385 bp, Homo sapiens
tttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagttggtagtgcatttgagcacacattttaattttcctctaattaaaatgtgcag

SEQ ID NO: 17551 - DNA, 620 bp, Homo sapiens
tctaccattggcaagttgccatcttcccaagttatttggtgcattacatgtaaaataaattccctctctcaatagagcaagaagatataataattgtaaacatatatgcacaaaataacagtgccccaaattatataaacaaatgacagaattgaaggaagaaacagacaaatctacattatatttggagacttcagtgtgccttcttagtaatcaataacaagtagagagcaaatcaactaggataaaagagacctgacaacactattatgacataactacatctataacttctccaacaaacagcagaatatatattatatatatacaactacacatggaatatcggtcattagaataaaccatgtgcaagccgtaaagtatcaatttcaaaaaaaattaaaaaatggaccgaccgcataaaaattaaaaggaggaaggatctaaatcattatctaagttctaccatatgagctggaaatagagcaaattagacccggagcaggtaaaggaaaggaattattaaaatccggaccggaatccggggaggtggaatagtggaaaccgggaggggaaaatgaatgggcccaaatctggtctttccaaaggtcagtaaaccc

SEQ ID NO: 17552 - DNA, 212 bp, Homo sapiens
aagaaatcaaaaccatcctggccaacatggtgaaaccccatccctactaaaaatacaaaagttggctgggcgtggtggcacacacctgtggtcccagctgcttgggaggctgaggcaggagaatcactcgaaacccgggggggcaaaggttgcagtgagccgggatcatgccactgcacctccagcctggcaacagagcaagacaccatctc

SEQ ID NO: 17553 - DNA, 299 bp, Homo sapiens
tccagatccaccaccagaggggttcttatttttaaagcaggatagacaattatgagtttgccctctttcccctaccaagttcaaaatatatctaagaaagattgtaaatccgaaaacttccattgtagtggcctgtgcttttcagatagtatactctcctgtttggagacagaggtagaaccaagtcagtctgtctctttttcagctcaattgtatctgacccttctttaagttatgtgtgtggggagaaatagaatgggctcttatctttcttgactttaaaaaaattattaaaaacc

SEQ ID NO: 17554 - DNA, 198 bp, Homo sapiens
tgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccag

SEQ ID NO: 17555 - DNA, 467 bp, Homo sapiens
  misc_feature 2, 3, 7, 10, 11, 12, 13, 14, 15, 21, 22, 26, 28, 31, 39,41, 57: n = A,T,C or G
gnncggnggnnnnnnaggggnnatgntnccnaaggaacncnctgtagaaaactgggnaataagcccgcgcgaactgcgtccgcaggcattcactaagcgtcgcagctagatacatacgcgacggaggcggccctacagtacagtctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggctatggtggtccatgtgtgctaaatgtgttcgtgacaggatcaagcgtgctttccttatcgaggagcagaaaatcgttgtgaaagtgttgaagcacaagcacagagcagaaagctaaataaaaaaatgaaacttttttgag

SEQ ID NO: 17556 - DNA, 419 bp, Homo sapiens
aactgagttacgggggaagaaaaagtgaataccctattgttgcaaggtaataaagagtaaacaggatacttgcttttggttagtgttttccagaatttactgttcttgttttgttatgttctttttgttccaagatcaaaagatcactcactgaaacaggaaggaatgttctaacagcagaaatatctaaacttgggcatctttagatgtttgcagaatgggaggtggaatgaaaggtggggcagctcactgatttgcgatgtatttcttccaaaaataaaggggtgcttaagctttagctgtaccaaaagccccgaatttatttaggttaggtttagaaataacaagattttgtaggtatttcctgtggagatattatatcacctagggagatatctctggctatagctatgaaaaaa

SEQ ID NO: 17557 - DNA, 567 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactgcactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggtataataatgtaacatggacatgatctcttataattctactttgagtgctggct

SEQ ID NO: 17558 - DNA, 420 bp, Homo sapiens
aagaatttgtgagagagatttagcagtcatgatttggaagaaatgtatttgctatttcatatataccaggcttgctctttgcagtgaatgggaagcctcattttggggaccaagaacctgtacaaggatttgtgatgaacttttccaatggggaaattatcgacatcttcaagccagtgcgcaagcactttgatatgcctcatgacattgttgcatctgaagatgggactgtgacattggagatgctcataccaacaccgtgtggaagttcccttgctgagaaattggaacatcgatcagttaaaaagctgcattgaggccaggaaatcaaagcagattctgacacaaactcgagacgagtcaggaagagacctgggaagatttagaggaaagggaaggggggcttaaaccttggtaatt

SEQ ID NO: 17559 - DNA, 306 bp, Homo sapiens
ggtgaaacatttattatgctgtgcggtacactcgaaccatgtataaggtgtaacctgtgtatcttttttttaattagcttttctgaatttaaattatattgtttttctttgtattgttaagcaaaatgcatcagaactggattttttttctcatctgaacataatataaaatttgaaagagtattgtgatattaagcactttaacatacatatcagacaaactgcgtgggtttttcaggtttgggagacatttaaatatgacttttcatgctttggtctttacaaataaaactgtgggattgataa

SEQ ID NO: 17560 - DNA, 570 bp, Homo sapiens
gaagaaactccacgaagaggaaatccaggagctgcaggctcagattcaggaacagcatgtccaaatcgatgtggatgtttccaagcctgacctcacggccgccctgcgtgatgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggattctctgcctcttccaaacttttcctccctgacctgaggg

SEQ ID NO: 17561 - DNA, 525 bp, Homo sapiens
agaagcgtgctctgccaagaccaaaaggtaagaagaaaaattccataagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgcctgcacagattgatgcaatgccaggatcatttctgggatgggaagggatgtgagatgatctggtactgcaacttcagcgaattgctctgctgccaaaagacgttttctttggccaaagatctctttcgtgattccttgcaacaatcaatgagaatcttcatgtattctggagaacaccattcctgatttcccacaaactgcctacatcagtataactgcatttctaggttctatataggcaatagagcatagattctataaattcttacttgctaagacaaggaaatctgtgtaaacaaggagtaataaaaggtaatcaatccaaaaaaaa

SEQ ID NO: 17562 - DNA, 192 bp, Homo sapiens
agggataggaagagtttgagtactaaggctcgaaaagggatttacccggctatgaggcatccgaaatgtcagaagctgttcttccctgttagggcccagaccctgccacgggaactttatcaatcaaggccaataaagagaagttatggggagactgatttaggatcaatattaaaaaaaaaaaaaaaaaaa

SEQ ID NO: 17563 - DNA, 564 bp, Homo sapiens
gggaggaattgaggcagccagcgcaggggcttctgctgagggggcaggcggagcttggggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatgggaa

SEQ ID NO: 17564 - DNA, 412 bp, Homo sapiens
actgaaccagagacccagacatgaagcatctcacttacaactctctgaacatcgacaaggctgacaaaaacaagcaatggagaaaggactccctattaaataaatggtgctgtgatagttggctagccatatgcagaagaatgaaacggtttcattctgcatatggctggccaacaacctttacctttcaccatatacagaaatgaacccaagatggattaaagatttaagtgtaagacctcaaactctaaaaatcgtagaagaaaacctaggaaatatccttctcaacatcaaccttagctaagaatttttggctaaatctcccaaagcaattgcaacagaaacaaaaattgacaagggggcctaattaaaccatagagcttttgcacagcaaaaaaaaaaaaaaaaaaaa

SEQ ID NO: 17565 - DNA, 434 bp, Homo sapiens
agaaccattttggtgtcttggcaattggttcttataccagagctatgtgtcttctcttctagaaagcgatatttaaaagtttgtattactgttaaaactaggttttgacaagttacataattttttttttggtttggggcagatgctcatatctgatacatagtgagtaatagcttaaaatgtgtctttgttcttgtcagtgaatattcttgttttatctccccatgttagaaaagtttgttttaattgatttttgggggggcccagtgaactggcttaacatagaatgaaactggctttcagcatcaactctattttaaataacatccctgttcattaaataaccccctaatttttcttgagtgtataacatttccaatgacaagatttgattttttaatttttaaaaaagctttcacaaaaagctttccgta

SEQ ID NO: 17566 - DNA, 187 bp, Homo sapiens
aggacaagtaaattactaagaggagagcagaactgacgggcatagagacacaaaaaacccttcaagagaatcagtgaatccaggaactggttttttgaaaagatcaaccaaatagacctctagcaagactaataaagaagaaaagagagaagaatcaaatagatgcaaaaaaaaaaaaaaaaaaaaa

SEQ ID NO: 17567 - DNA, 337 bp, Homo sapiens
gaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatcagagatgatactcaaattataataaaactcttcattttgtgaattatagaagctactttttat

SEQ ID NO: 17568 - DNA, 184 bp, Homo sapiens
ataggaagagtttgagtactaaggctcgaaaagggatttacccggctatgaggcatccgaaatgtcagaggcctgtttccttccctgttagggcccagaccctgccacgggaactttatcaatcaaggccaataaagagaagttatggggagactgatttaggatcaatattaaaaaaaaaaaa

SEQ ID NO: 17569 - DNA, 282 bp, Homo sapiens
gtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaatttta

SEQ ID NO: 17570 - DNA, 384 bp, Homo sapiens
cagcggaggggcttctgctgagggggcaggcggttttctgaggaaaccgcagataagatgttttctgtttgaaagatagagattaatacaactacttaaaaaatatagtcaataggttactaagatattgcttagcggtaagtttttaacgtaattttaatagcttaagattttaagagaaaatatgaagacttagaagagtagcatgaggaaggaaaagataaaaggttctaaaacaatttggagaagatagaagtttgaagtggaaaactggaagacagaagacgggaaggcgaagaaaagaatagagaagatagggaaattagaagataaaaacatacttttagaagaaaaaagataaatttaaacctgaaagtagggggc

SEQ ID NO: 17571 - DNA, 419 bp, Homo sapiens
attataattcatagcttgaagaaatgtgacatctccctgcaattcttcttgcctttctacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgcttcaagaaaattgaggggcattccattcactggccctgccgactgaccattggctccaatttgtctataaggattgcagcctataaatcgattctacaggagagagttaaaaagacttgacagttgtggatgcaaaaaccctaaaaaaagaagattt

SEQ ID NO: 17572 - DNA, 490 bp, Homo sapiens
gaagttttaagacaaaggaaaaattggtggaaggatggtcgttttcagtctgaatgggttggtccttgcgtcatagactatattacagaaagtggatgtgctgcctgagagacaacactggggttagactgaaaagacctatcaaaatgtcccaccttaagccctacataagaggatccagtgaacaagaaagtctttatctcttgcgaggttcagtagtggcagatcatgactacattggattgcctgaaattccgattggagcatatcaagcaaatattctggtggaagatgcaactattgggataggccgataatgaattactgacatcaagcaaggatcgggaactattaggaatatagaaatacgaaaatctctccattgatagacgacataggtctcttggaaaagcagactttcagtctgcggactctcaaaccaggtcttggatacctaagtaggaaatccaaaattatttaaatggtgggt

SEQ ID NO: 17573 - DNA, 588 bp, Homo sapiens
gacagcccctgtgtgtcaggaattattagtggctttatatacatttcaatgtaatcttcctaatggtttattaaactatgtactattaatttgataaataaactggtgctgagagaatttgttaattagctctggtgaaatcatgagcaggtaatgacaaaaccagaattcagactcttactacagagcccccactctttgctttaccccacaatgcctctcttgtcaaaccatgaaattgtccaaattgctatttttccccccacagttccaaggtctcattctgacagtgaaagcgaatattctgcttccaactcagaggatgatgaaggggttgcacaggaacatgaagaggcactaatgcagtcatattcagccaaaagattcaagctcagaatagagtagtttcagctcctgttgcaaagaaacaccttctaagagaatgaaaagagataaaacagtaagtgaagagagagactttaaccttaaagaaaaattgtgtaatatttcaaagataggctaccctaagagatccacatctctcaaaataatatttttcttcacttttctatattttctcagccttcc

SEQ ID NO: 17574 - DNA, 449 bp, Homo sapiens
taatctgtgggagcagcttattccagtatcacctcagggtgcagccacaccaggactgtgttgaagggtgttttttttcttttaaatgtaatacctcctcatcttttcttcttacacagtgtctgagaacatttacattatagataagtagtacatggtggataacttctacttttaggaggctactctcttctgacagcctagactggcttctacactaagacaccatggaggagtatggcccctattattcctggtttggctctgccaaacccttctttagccttcacacatcggactgaagaatatgatgctgaaggatatggaagacacagatgatgatgatgatgatgatgatgatgatgatgatgaggcaactctctttttccaacaagagaccaagaagccatttttttccatttgatctgtttccaatgggccatttggga

SEQ ID NO: 17575 - DNA, 165 bp, Homo sapiens
attgcgagagatgcattagcttgctagaggctagattcgacaggtcaggggagggagccgagaataagtgctgtgttttcagagagtgctgcacagggtgactgcaggcattcagctttctctggcatcatctggcatgaataaaatgcttccttcagtttcaaa

SEQ ID NO: 17576 - DNA, 566 bp, Homo sapiens
cagaagcacagtaattctgctcttggcatgtgaactgcacgataaaggaactcaggcgcctcttcttagttgatgatttagttgattctctgaagtttgcagtattgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttattttagccatgcactgttgtgaggaaaaattacctgtcttgactgccatgtgtcatcatcttaagtattgtaagctgctatgtatggatttaaaccgtaatcatatctttttcctatctgaggc

SEQ ID NO: 17577 - DNA, 342 bp, Homo sapiens
tcaggattatgctgaaaagggactgttcacagacctcagtgatgtgagcactgttgctcaggagggacaagttgctaatatgcagaagggatgggtgatacttcttgcttctcatgatgcatgtttctgtatgttaatgacttgttgggtagctattaaggtactagagttgataaatgtgtacaggggccttttgcaataaaactgggtatgacttgatccaagtgtttaacaattggggctgttaagtctgaccatacatcactgtgatagaatgtggctttttcaagggtgaagatcaagcttaaccacagggaacttacagttcctttaaaaaaaaaa

SEQ ID NO: 17578 - DNA, 189 bp, Homo sapiens
aatgcccaaagtaacgtagaaactcccgagagtagctttgactcaggatgagaaacctccgattgcaggcagagatgagttttctttctagcttggggggtatttatgggaaagccccgagctttgggggtgtatttttattttttgcctttggcggtggtgctgatattatcacgaatggcgtcgggg

SEQ ID NO: 17579 - DNA, 478 bp, Homo sapiens
gcttgctatgtcacccaggatgtagtgttgtgacgcgatgatgactgattgcagcctcgatctcccgggctcaagcaatcctactacctcagcctcccgagtagctgggactacagctacgcaactgtgccacctcagagaagtagatttttaaacaaacccaattttctcttgctgttaacaacactgaagactagtagcagaggagtgaaagtgtgggttaagagccttaaaaactggtggaaagggctcgatgccagtggagagcacttagttatttcagtgagaagagagcacctaaacctgggtctgaaaacacatgaaaactccaggccttgtcccggcccttctgcacattgggggcggggccagagctccactgatggccttgctcatgacttcatctagaaactgagcaacaggatttctaggatttcaacgcccaaagcatccacccacccacagagaccatcacacc

SEQ ID NO: 17580 - DNA, 527 bp, Homo sapiens
caggactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgcaatatttagtaaagcttttcttttttaatttccaggaaaaaaataaaaagagtatgagtcttctgtaattcattgagcaggttagctcatttgagataaagtcaaatgccaaacactagctctgtattaatccccatcattactggtaaagcctcatttgaa

SEQ ID NO: 17581 - DNA, 367 bp, Homo sapiens
atgagccgactatctcagctaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggccagtgttctgatttgggctggacaaagtgccaaaggatcttccccctgacacaactctgctagacctgcaaaacaacaaaataacccaaaaaaaaaa

SEQ ID NO: 17582 - DNA, 328 bp, Homo sapiens
catatcaaagattaaggtatacgcaacatttcctctaggccatgtgtgctgatggaccatgagggtaaaagtgctggttttgtaatagtacatatcgccctcagcactctgctggtttgtatgaacatcaagtatgtttgagaatgaagtgcaggaaggtggaggtaaccaagctgccatctctagaaaagtccagtgtggtgggtgggtgggtgccacaatgaaatagtaagccacaccaaagccccgtactagatggaatacagtaacacagttgtatcttgtaaacatcatgccagtaaaaaggagtacaaaaaaaaaaaaaaaa

SEQ ID NO: 17583 - DNA, 258 bp, Homo sapiens
ctaaggcaatgcttatacaattgaaagtaaaacaaaacgtgatatatgctttcatattgcccactggtgaaaaataatgaaattctactagagagctgtttgatactaattttcatctttcaaacatttcctcttaatactaaaaaatatataaatcattcatttacattaaatgcgaaggaaggcacaactggttatagtctatataagcacacagtttagcatactcagaactaaaaaaaaaaaaaaaaaaaaaaa

SEQ ID NO: 17584 - DNA, 386 bp, Homo sapiens
agccaaccaagatgcgaatgttttgaaatgatatgaccaaaattttaagtaggatagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 17585 - DNA, 430 bp, Homo sapiens
cccaggatgtggaactctgggagggagaagtggtcatttgagctctctgtggaagaacagataaagagaagtcggtattatgatgaggatgaggatgaagagtgacaaattgcaatgatgctggccttaaattcatgttaagtgttagcgagccactgccctttgtcaaaatgtgatgcacataagcaggtatcccagcatgaaatgtaatttacttggaagtaactttggaaaagaattccttcttaaaatcaaaaacaaaacaaaaaacacaaaaaacacattctaaatactagagataactttacttaaattcttcattttagcagtgatgatatgcataagtgctggaaggcttggactggggaaatattccacctgataatagcccagatctactgtattcccaaaaggcaatattaagggagat

SEQ ID NO: 17586 - DNA, 155 bp, Homo sapiens
taatgaattgatgagaaatacaatgaagaggcaatgtccatctcaaaatactgcttttacaaaagcagaataaaagcgaaaagaaatgaaaatgttacactacattaatcctggaataaaagaagccaaaaaaaaaaaaaaaaaaaaaaaaaaaa

SEQ ID NO: 17587 - DNA, 602 bp, Homo sapiens
gacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgtcttgtgtataactttatat

SEQ ID NO: 17588 - DNA, 404 bp, Homo sapiens
gtgcatggagaaacgagacaggatagtagacggcgctgtgaacgtgctataggacctggtcaaacacacaccatcagaattcaatattcacctgccagactggcttatcaagacaaaggtgccttcataatgaagttaaagtgagtatactgtggagaggacttccaaatgtggttacctcagctatatcactgcccaacatcagaaaacctgcggctatgattactatgccttttctaaagatcaatactataacattgatgcgcctagtagaacaagcaagagcaattactactcggtttgggcagaccttatccaaagctgcacaactgccttagactgatgagcaaaggaggaggcaactaatgaagaaatgaataataaatttgacactgaaaaaaaaa

SEQ ID NO: 17589 - DNA, 303 bp, Homo sapiens
accatttgttgccctgtgggagtgcaaagttagagtttccagaccttctgatcgttaagagaggctggaaatccgtatttttcaagaggatcgagttgccaactcattgaaatcttctccaagccctttgcgagtcagcattggttagcatgtctcgaacacatggtagctcaaacacgcacggtagcttgccatggtggcaatttcaaattgcattcattgatttcaaaagaccatcaatttcaaattgcattcatcttttgagttgcaaataaataaaaaaaaaaaaaaaaaaaaaaaaaa

SEQ ID NO: 17590 - DNA, 310 bp, Homo sapiens
aacgacttgatctagtccaggaagcaagctgatgtatcggcaggaaaaaatgcccaaaactcttcaggagcttgtgtgccatgagaaagagacaccaaagcgcgaaaagttactttcaatggactgaaccagatgattgtcatagaactggggaccaatccgctgaagagctcaggaattgaaaatgggggttccagggaatgaagaagctctgctacatccgcattgctgataccaatatcaccagcattcctcaaggtcttcctccttcccttacggaattacatcttgatggcaacaaaatcagcag

SEQ ID NO: 17591 - DNA, 347 bp, Homo sapiens
tttactcgaattggtgacaatgtcacataatgaatgctattgaaagggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaagg

SEQ ID NO: 17592 - DNA, 500 bp, Homo sapiens
cgagactggcagcgcagggccttctgctgagggggcaggcgtttttcggggccgccgcggacaaagatattttctggtttgatagatagagattaatacaactacttaaaaaatatagcaatagggttactaagatattgcttagcggtaagtttttaaccgtaagtttaatagcttaagagtttaagagaaaatatgaagacttagaagagtagcatgaggaaggaaaagataaaaggttctaaaacatgacggaggttgagatgaagctcttcatggaggaaaaaatgtattaaaagaaaatgagagaaaggctacagagccccgaattaataccaatagaagggcaatgcttttagattaaaatgaaggggcttaacagcttaaaggttaagtttaaaaggtggagggggattaaaataatttggaggcgacttttaaaaagagattaaaccgaaggtggttaaaagaccttgaaatccatgacgcagggagaatgc

SEQ ID NO: 17593 - DNA, 556 bp, Homo sapiens
tgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatact

SEQ ID NO: 17594 - DNA, 437 bp, Homo sapiens
gagagagtagaggtggactctgtgtgaggttaaagaaaacaatttctcctgctctgagctggtgttcagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggtgggctgggcgcggtgctcacacctggtatcccagcactttgcgaggccaaggcggcagatcatgaagcagaagttcgagaccagcctgaccaacatggctagtgcacaatagtcctttcccaaaaggagcacctccagtcactcagattgggatgacagacacagccaaccacattcgaagcagatatacactggggccctgctctccg

SEQ ID NO: 17595 - DNA, 285 bp, Homo sapiens
tacaggtgtgcgccacgacacccggctaagtttttgaaatttattttttgtagagataggattttcctatgttgcccaggctggtttcaaactcctggccgtaagcgatttttccggcctcccaaaacgttgcgattataagtgtgagccactgcacctggccccacattttctttatccatttgtacattgatggacacttaagatgattccatatctttgctattgtgaatagtgcttcaataaatatgtgaatgcacaaaaaaaaaaaaaaaaaaaaaaaaa

SEQ ID NO: 17596 - DNA, 488 bp, Homo sapiens
ggctgacagagaagattcccgagagtaaatcatttttccaatccagaggaacaagcatgtctctctgccaagatccatctaaactggagggatgttagcagacccagcttagagttcttctttctttcttaagccctttgctctggaggaagtctccagcttcagctcaactcacagcttctccaagcatcaccctgggagtttcctgagggttttctcataaatgagggctgacattgcctggtctgcttcgaaggattcaataccgtcagtattttaaatgaagggattctaagattgggttgggacaataggaaagcatatgcagccaaccaagatgcaaatggtttgaaatgatatgaccaaaattttaaggaggaaagcacccaaacacttctgcttcacttaagggctggcccgaatactggaggaacaagcatgatcttgtactgggatatttaaatatccacagactcactttttccaaa

SEQ ID NO: 17597 - DNA, 300 bp, Homo sapiens
ccctgatgtcttatttttgcaggcatgtcctaattttgggtgcctaagtaaagatttcaagtgccttaatggctgaaggagacagaatgggcaaagggactgaagatctatgctttagttgctgagagagctgtggggccactgatagaagcagagaagtgagaaagggaattgggttggttggaagggatggttgaaggaggcaagtcagctttgggcatattagattgaggggccattggccagataaggattctcttttgatgatagccctggatggataatagagcagggactggg

SEQ ID NO: 17598 - DNA, 512 bp, Homo sapiens
tagcgcggcgtgatagccatgacagcaaagtttttggcgacaccttgtacgaggaggtgcgggaagtctgcacgggaaccagcgcaagcgccgcaagttcctggagacggtggagttgcagatcagcttgaagaactatgatccccagaaggacaagcgcttctgggcaccggcaggcttaagccactccccgcctaagttctctgggggggcctgggggaccagcagcactgggacgaggctaaggccgtggatatccccacaagggacatcgaggcgctgaaaaactcaacaagaataaaaactgggcaagaagctggccaagaagtatgagcggttttggcctagagcttgatcaagcagattcacgaatcctcggccagggttaaataaggcaggaaagtccttccctgctacacacaaagaaacatgggggcaaagtggatgaggggaagtccaaaacaagttccaaaagaagaagtgttatggcctgcttgaagctgtgggcacgt

SEQ ID NO: 17599 - DNA, 410 bp, Homo sapiens
acagcagaacattagtgccaatttacaggcttgtttactctaactggattccacatggctccgccactactatgaaattattcggaactaaagcaatgaaagtaacatgtaaaagaataaatttactttccaatgtattatatttgggtggatttggattatggatcttggtttaagaaggctctggatggggacagccctgaatctgtagatttcttttcctagaacagcctgcaattggatgctacccggggggttctgtgaggtgcctactgctcattcccatggcgcttggtttatttatttatataatgggacacattattcctggcagcaccagcaatctgcatctctcaaatcaagatgtgatcaacaacagagtttctgctaaggttgggaaaaaaaaaaaa

SEQ ID NO: 17600 - DNA, 440 bp, Homo sapiens
ttctcttctgtaaaaaccagttagttttatcaggttgtgtctgaacttcctgcaaactagagaatcactaacgtggatgtataattctgttttcctttttttaactcaggaactcacatgactttatgtaaatcacattttcttccaccattattaagtctctgtaggatatatcgccataaatctttgtgaaaagatatctaaagctggtcttcaggcgttttcagaaaattctacacagattgtgcctggaaatttgaaggctgcctttagaattcagctgacattcatgagccttaagaattaggataacatgaggccaggtgcagtggctcacacctgtaatcccagcactgggggaggccgagcaggtggatcatttgaggcaggagtcaagaccagcccaaccaatgtagcgaaccctgctcctctattaaaaa

SEQ ID NO: 17601 - DNA, 289 bp, Homo sapiens
tcaatatatgggatattaaatgcatgtgattagtaaacagtcttgaaatatgcccagagttactcagtagcttcttttttataattttaattgtggtggactcacatttgtgggtttaaattgtctgagttattgagtgttgtattttgtagcccccttctttaattttcagaagcactgccatttcatttcggtttataaaaatgcacatcttttggttattgtatgatttatccatgtgtgtttctagccaataaactgtgccttgcaggcatgaaaaaaaaaaaaa

SEQ ID NO: 17602 - DNA, 442 bp, Homo sapiens
aagctcatatattgcccttttagaagtgtaggaactctgcacaaataatggagaaacaaattaccaatttcaatacaaaaaattttgcaggatagtggaatttgtaagcttgtcataccttgattttttgaattcaccttttcccaaaagaaagcaactgttggcagcacagtggctcatgcctgtaatcctaacactttgggaggctgaggtgggcggatcatgaggtcaggagatcgagaccaacctggcaacatggtgaaaccccgtctctactaaaaatacaaaaattagctggcctggtggcacatgccctgtaattccagctacttgggaggctgaggcaagaagaatcgcttgaaccagggagtcggaggttgcagtgagccgggatcatgctgctgtctccagcctagcgcagagcgagactcctctcaaaaaa

SEQ ID NO: 17603 - DNA, 298 bp, Homo sapiens
aagcaatttggctgggcacgttggctcacgcctgtaatcgcagccatttgggaagccaaagagggcggatcacttgaggtcaggagttagagaccagcctggcaacatagcaaaaccccctccctagtaaaaatacaaaaattagctgggagtgatggtgcatgcctatagccccagctacttgggaggctgaggcacgagaaccgcttcagtccaggaggcagaggttggggggggccgagattgtgccactgcactccagcctggatgacagagtgagactcttatcccaaaaaaa

SEQ ID NO: 17604 - DNA, 413 bp, Homo sapiens
acagcaagtgtatcttttcttagattcttttgtgggggaaggggagtggctaaaatttatgtctgagaaggttgacagtggttcaaatgtgaagaggcattaaggaaagacaactaggattcaataaagacaggctactaaaattaaaattaaaaaaaaaaaggatatggaatctttatttagattttgtttcaatgaaaaaggatgggatgggagggtgccaaggctaaagaaaaggatttacctttcagtcattcaatcagatgagtggctaaggaataaagataattaacttgcatctttaagctttccctctagtctcaaactgggaggctcttctttttcaagtgtaaattatgtgtgtaaattaagatgaaatatgtacccactgtaagttttaacttccttataaa

SEQ ID NO: 17605 - DNA, 518 bp, Homo sapiens
cctgctctgcgaactggagtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccac

SEQ ID NO: 17606 - DNA, 538 bp, Homo sapiens
acctaatgatcattttaaattactgaagtgtatagacttataagaatgggttcaaggatatctctataagaattaattcagtagcatttcagtgtactttcttgagaggggaaaacagagtttgagttgcagccagcaagttgagaatcctatgtgtgaccctagatacaccttcctgtgtgtcaatagcaggaagaaggtattttagagtcacggaggtagagaaaatagcatggctttctcagccaggtacacttaggttcaaattcatctctggcatttagaatttgagtgacctggaggagtaaactcacttcatgtctccaaatcacattgtctcatctctgaaatgaactgctttactgagtagttgtgagcatttagctctatagctgcacataatagaaactttttattttaaaaaaaagctcattagttatctaaaaggtaatactctctggaaggggtggtatgaaaatacattgctgcatcggggtgtccagtctggagaggtataagtgtcaaatacttgaggttc

SEQ ID NO: 17607 - DNA, 504 bp, Homo sapiens
aatggcagatggaaaaccggtgaatctgggcttatgggatacagctggacaagaagattatgacagattacgccccctatcctatccgcaaacagatgtgttcgtaatttgcttttcccttgtgagtcctgcatcatttgaaaatgtccgtgcaaagtggcatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccctggaacctttgtacgctttgccc

SEQ ID NO: 17608 - DNA, 361 bp, Homo sapiens
ttactatagccggacaatggcgaagttgtcagtagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaatactgaaaaccaggacttggttcaacatttaaatttgatagttgccctgattcccattgtgggtttgtgaaaagtgtatgtatttaaatttgctgtaaaacataatcactaataatatgcaataaatattgtccaaaaaaaaaaaaa

SEQ ID NO: 17609 - DNA, 425 bp, Homo sapiens
tctttgaaagatagagattaattcaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttggaggtgattaaaataatttgaaggcgatcttttaaaaagagattaaaccgaaggtgattaaaagaccttgaaatccatgacgcagggag

SEQ ID NO: 17610 - DNA, 110 bp, Homo sapiens
gagatggggatgaggcggagaacgagatgactgatactttcatctgggccgatgtggcttgacatatttctgtatgtctccatctattgatgagggtcttaaaaaaaaaa

SEQ ID NO: 17611 - DNA, 177 bp, Homo sapiens
ggagaagagaaaagagaaagccaagatccactaccggaagaagaaacagctcatgaggctacggaaacaggccgagaagaacgtggagaagaaaattgacaaatacacagaggtcctcaagacacacggactcctggtctgagcccaataaagactgttaattccacaaaaaaaaaa

SEQ ID NO: 17612 - DNA, 388 bp, Homo sapiens
caaaaagaacgtccactcagagacctcatcccaaggtcaccaacattaaagaccaaaggtagccaaatccacaaaaatggggagaaaccaacacaaaaaggctgaaaattccaaaaaccagagtgcctcttctcctccaaaggatcacaactccttgccagcaagggaacaaaactggactgagaatgagtttgacagattgacagaagtaggcttcagaaggtgggtaataacaaacaacaaactccttcaagctaaagaagcatgttctaacccaatgcaaagaagctaagaacattgacaaaaggttacatgaattgctaactagaataaccagtttaaagaagaatataaacgacctgatggagctgaaaaacacagccaagac

SEQ ID NO: 17613 - DNA, 364 bp, Homo sapiens
aaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggcatactggctggcttcgttctcttaatatactcaggaatgactcaagcctctggctattaacataccctagttgccggttt

SEQ ID NO: 17614 - DNA, 163 bp, Homo sapiens
aggctcactcttaactgcgcgagcacacttcatggaaacccgagacggggacacaggcggaagcctaggagagccgaatcagggggggaagaggcaggactgggccagagtgacagacatacggggatccaggaggctcaaagagaagccaagtcagctgtgt

SEQ ID NO: 17615 - DNA, 170 bp, Homo sapiens
gcagaaccgggaacatgacatgcatcttgatttacatctgatgtagcagggcatgcaccaatagcaccagctactcaggaggctgaggcaggaggattgcttgagcccaggagttcaaggccagcctgggctacatagcaagaccccatctctaaaaaaaaaaaaaaaaa

SEQ ID NO: 17616 - DNA, 127 bp, Homo sapiens
aaaggataagcaagaaagagaagaaagagaaaaagaacgggagagagaaagggaagaaagagaaaggaaaagacgaagggaagaggaagaaagagaaaaagaaagggctcgtgacagaaaaaaaaaa

SEQ ID NO: 17617 - DNA, 180 bp, Homo sapiens
aaaacagcgaaggggaaagaagcagtgcgagctctacagtcagagaggcccgagggcgtgacaccaggacctcgtgtataccagtagaccacgaagggctaggagccgcacttccctccaatgcaggataggcacacatgagaatctaatgagaaaaggcctggaaagctcctagctcag

SEQ ID NO: 17618 - DNA, 330 bp, Homo sapiens
acctgaatcagtgggtataattcatcagtgtctgggtgcttcaagttatttttcttaatgctgatgttaatgcatgcccatctttatgcctcaacacattgcacaatgaaaaacaaaaattattttggaagacacagctgacatctatatgaaatattcagtatcagtgattgaacttcagcaagctcctgtgaccagcagggttttacggaggtgcaactgctctcccacgatcacttatcataaagccagagacaattgggccaatgtagcctcttgcctgcttttgtgtacaaaatataaatagaatagaacaaaaaaaaaaaaaaa

SEQ ID NO: 17619 - DNA, 125 bp, Homo sapiens
caaaggaggagggaaacaaaaagtcataaaacaggcaggtagaggtatacggaaaaataaggtggggaggggagagtctaactgtaaaagtaaaaaggtagaagatagaaccgtcgaaaaaaaaa

SEQ ID NO: 17620 - DNA, 374 bp, Homo sapiens
acaagagtactggaactttttggagcttatgtacaagaaataaagttcatatttttaatttttatcttttaattcaattttccatgaaagttttgatgtcccctcatctatacagagtgctgaaggaaaaaaatccctgacaatcaagaatagtatatatggcaagacttttaaaagtgaagaataaataaagacctttctggataaacaaaaggcgaggaattaattaccattatgcctgccttataagaattgttaaagggagtttttcaggttgaaacaaagggatactaaacagtaacatgaaaggatatggaaatataaagctctctggtgaaatacccatggtagatgcaccagataaaaaaaaaaaa

SEQ ID NO: 17621 - DNA, 401 bp, Homo sapiens
cctctggtgcgaaattccggatttccttggtcttccggtaggagctgtaatcaattgtgcggacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagcatagtgaacaataaaggcgagatgaaaggttctgccattacaggaccagtagcaaaggaggggcagacttggggcccggattgcatccaatgctgcagcattgcatgattctccag

SEQ ID NO: 17622 - DNA, 251 bp, Homo sapiens
  misc_feature 9, 22, 42, 44, 77, 83: n = A,T,C or G
taaaacacnacgatgaaaaggnacaagcatcaagcacgcaantntgcaggtcaaaacgcttagcctagccacacccncacggnaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaa

SEQ ID NO: 17623 - DNA, 137 bp, Homo sapiens
aaaaactgcggactgcatacttacagtgcagaccaaacagagattcaagtgtccagaagaggacaagacgacagacaactctttctttaaataaattaagtctctacaataaaaacacaactgcaaagtaaaaaaaa

SEQ ID NO: 17624 - DNA, 410 bp, Homo sapiens
gaccagacttcgctcgaactcgtttcctcggttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgcaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggg

SEQ ID NO: 17625 - DNA, 440 bp, Homo sapiens
gagactcttcattttgtccactttgacaggaaaagtgggaatttatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgtctggtggacaaataacctaggtactccaaatcctggcaggaaaaatatacagcattatgaaacagcctcagtaatcctaaaatgatttccaaagctggttacacatgacctgcaaagtctattaaattaaaagactttctcattacagaggttagcaacgtagcaaaaccatgggaaat

SEQ ID NO: 17626 - DNA, 301 bp, Homo sapiens
aaaatgcagattttcgagaaaacccttacggggaagaccatcaccctcgaggttgaaccctcggatacgatagaaaatgtaaaggccaagatccaggagaaggaaggaatccctcctgatcagcagagactgagctttgctggcaagcagctggaagatggacgtactttgtctgactacaatattcaaaaggagtctactcttcatcttgtgttgagactgcgtggtggtgctaagaaaaggaagaagaagtcttacaccactcccaagaagaataagcacaagagaaagaaggttaagc

SEQ ID NO: 17627 - DNA, 266 bp, Homo sapiens
aatgaaactaaacttttaaacatctccattatatctacatccttttgaaggtatttatcatagttgccaattttaattttaggattgactttccctttctgaatgacttcataaagtttggtgtgaattttgaagacttgggttactaatgattgtatctttgctagtcaacaacttatgaaatatactcaatgcgctgatgtgcattaagtgcggaaataactaagacacaaataacctttgcaaaccttcaagctggggaatat

SEQ ID NO: 17628 - DNA, 164 bp, Homo sapiens
tgacagtgccaaagcacctcactatgggctttgtcagcttaccacggacaacaaaggcaactcaaaagcgggaaatggaacattggaaaaccaaaaaggaactggagtaaagaagagccctatggtgtgtggacaatatcctgttaaaagtgagggaaaggagc

SEQ ID NO: 17629 - DNA, 299 bp, Homo sapiens
tacatgggcagtgacgaagcgaaatttgaagatgacatcgcctattggcttaacagagatcgaaacggacatgaatactatggcgattactaccaacgtcactatgatgaagactctgcaattgggccccggagcccctacggctttaggcatggagccagcgtcaactacgatgactactaaccatgacttgccacacgctggcaagaagcaaatagcgattctcttcatgtatctcctaatgccttacactacttggttctgatttgctctatttcagcagatcttttctacctact

SEQ ID NO: 17630 - DNA, 266 bp, Homo sapiens
  misc_feature 6, 7, 8, 9, 10, 18, 25, 29, 34, 59, 62, 69, 76, 78, 81: n = A,T,C or G
cggggnnnnnaggggggntcgaaancctncgganggaccccggcaataactggggaaangancccgcanaccgctngngtngaatttggccgcccccctaccgagcctagcccagccctcagccatggcatgccgactggggcaggccattggcctactcgtggccatcttccacaagcactcgggcagggagggtgacaagcacaccctgagcaagaaggagctgaaggagctgagccagaaggagctcaccattggctcgaagc

SEQ ID NO: 17631 - DNA, 353 bp, Homo sapiens
caaaacggctcggaggaggccaaggcgcaacttacttcggttgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggcccctgggtctgtctccaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagac

SEQ ID NO: 17632 - DNA, 203 bp, Homo sapiens
ggattgggaccaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcc

SEQ ID NO: 17633 - DNA, 319 bp, Homo sapiens
ggaatacccccaaatttaaaagagggcaagaaaagagagacaatagaacataaaacaaatgggacaagaataaagtacataggtgtcacaggcccttgggtgctgctgtaacaaaataccggagactgggtaatttacaaagaacagaaatttatccattcatggtctggaggctgggaagccaagagtgaagggctgcatctggagagggtcatctggctacattataacatgatggaaagcatcacatggtgagagagagcaagagaggacagaacttacttttataacaaactcattctcacaataaactgctccc

SEQ ID NO: 17634 - DNA, 115 bp, Homo sapiens
cctgtcagcagtgtctgacatgctttaaaaaaaaaaagcacacccttaccaacatggagaacttttataatttaaaaaaagggtttcaattaagcaggcaaaaaagggtatatgt

SEQ ID NO: 17635 - DNA, 396 bp, Homo sapiens
tggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggggcagcattcagcagtatatttataaacaggaacctgtacagaagtgccctggaaga

SEQ ID NO: 17636 - DNA, 241 bp, Homo sapiens
caaatcttaccccgtttgtgaaccaaaaacatcacctctagcatcaccagtattagaggcaccgcttgcccagtgacacatgtttaacggccgcggtaccctaaccgtgcaaaggtcgcataatcacttgatccttaaccagggacctgtatgaatggctccacgagggttcagctgtctcttacttttaaccagtgaaattgacctgcccgtgaagaggcgggcatgacacagaaaaaaa

SEQ ID NO: 17637 - DNA, 347 bp, Homo sapiens
cgaaattatggttaacctcagctgtgatcttatgtatgtaaagtgaaatttaaatagataattataggttgattacaaaatccatagtgtcattttattttagtcattattgaattataccatttactctgctttcttatagtcttaattttattatattttgttggtactgtattatatttgaaaaccttcaaattagaatacattgtacagttaaagaaattgacttgggacttaaaagaaagatttcccattgcatacaggttattggagaaatttccttttgtgcatttgtggaagtagttttctggcccgggccttaatttcttaatcaacctaatacatca

SEQ ID NO: 17638 - DNA, 294 bp, Homo sapiens
agaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagc

SEQ ID NO: 17639 - DNA, 124 bp, Homo sapiens
aaaaagcggccgtatgaatagccgaagatggagcttagttttagactgggaaggaggcggggagaaatgatgacgtgtgaattagagcaatgaaaggagaggggcacgcatgagaaaaaaaaaa

SEQ ID NO: 17640 - DNA, 392 bp, Homo sapiens
ctatagcaaatgaagacaggcacgacagtacctcagctgagagcatgcgcacttatgatataaacagaggaccagctccattctcaggaaagaaatgttgtgatggcaagccttacccaaatatcgtttacacagagagatgactatggcagtgatgtttaatattataaaatccaggcatttcgaatctgtttttcatgatttatagagggttacacaaagtgccacttattaaagagcttccacagtgaagatggagaaggtgaacttgctttgaatattccagatgtgtttggcatgcgtatggcagtgagcaggtatgtgtttgcttttgcttgcactgaaagttaaattgctatcaagagcaaactatgaacggtttttattcaaga

SEQ ID NO: 17641 - DNA, 209 bp, Homo sapiens
aaagaatgcaggaaaaataatttaatatcaacctcagttgacaaggtgctcagattattcaattcgggatcctccttttgttaggtttttgagacaaccctagacctaaactgtgtcacagacttctgaatgtttaggtagtgctagtaatttcctcgtaatgattctgttattactttcctattctttattcctcttcttctgaagat

SEQ ID NO: 17642 - DNA, 378 bp, Homo sapiens
tctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaaagtggggatcggagacatgtaagcagcatcatggaggtttgaagatgccgcatttggattgggatgaattccaaat

SEQ ID NO: 17643 - DNA, 331 bp, Homo sapiens
taatgagtggaaatcattaattggtgcttaaactacttaccaattcagctttcaggtttcaagtgaaagacacgcaattctttcttgcacctgaacaacttagagggcattgtagggttgtaattggcctaatttcaatattgttgtatctcaggaaatggtgaggcctgaggacaaagaaagagatggggaacatctggcaggaaaagagtcagaacatacgtttatcaattcagtttgctgtcttaaatggggctggtcatgggccacaaactattaacaatagtaacatcaaagaatatggatcatagattaccatcacagataaaat

SEQ ID NO: 17644 - DNA, 388 bp, Homo sapiens
aaaaagcttggaaaatactacacactttctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagctgggggggatgtgaaaataattttatgaggtcgtctaaaataaagagtag

SEQ ID NO: 17645 - DNA, 355 bp, Homo sapiens
gagagtctggctgagaatccagtgaattatttcagatcttaactaagaccatcaagggagtacctctatgagtcaacaagagtggagccccttaatacggataccactgcaatgaccaaagacttagatcacaacacccaagtcttcaaatacttagaaaaccttcccaaggatcagtataaacaaggctgacccatgaaggctacaataaatacctaattattcaatgcccagacactggcaaacatccacaaacatcacgaccttccaggaaatcatgacctcaccaaacaaactaaataaatcaccagtaaccaatcctggagtgacagagatatgtgacctttctgacaaa

SEQ ID NO: 17646 - DNA, 149 bp, Homo sapiens
ctcagaggaactactaaatatatagtttgagcacagtggcgcacaccggtgagcccaacacttggggaggctgaggtgggagattgcttgaggccaggagttggaggccagctcagaaaacagagaccctctctacaaaaaaaaaaaaa

SEQ ID NO: 17647 - DNA, 426 bp, Homo sapiens
cattaaccttcttgtttaatctgagttgacctataagtgggcatattgttttttggggaatcgggagttttctcaagtagaaagaagccccacttttcctttgatagggtaccagtcaaggaaataaatgctcttttttctacctgagttagatttgcctttcatttgctcaccctgatctgtgtggctttattgaccactacagtttaagcccatgcaacctgcatgctgtgcaagaaagaaaggtgatggacagatagtcccagagttaaacttctgggcctttgccactccatgtcttgccatcttatcatcatagtagctttgggtatggcctcctagcagctcattggtatgcctgtggcattcgggtcccactgtcaggcagattctgggggactggggagccagaatgatgggaagcag

SEQ ID NO: 17648 - DNA, 239 bp, Homo sapiens
agtgaaaaggagtccaattcatagagacagaaagggttattgccaggggctggggagggggaaatgagaagtttccttaatgggtttagaatttcagttttgcaagatgacgagttctgtggaaggatggtgatagaaactcaataatgtgaatgtacttaaagccatgcattgtacatttaaaattgcttagatggtaaattttatgttcggtgtgttttgccaaaaaaaaaaaaaaa

SEQ ID NO: 17649 - DNA, 217 bp, Homo sapiens
tgagaaaattgggtttgaaaggttgaaaggtgcctcaggtctggagacaaagctatctggcttatacttcctggtcacagtcatacctgagataaagtcagggtaggacttcaaggaggaactgaagcagaaaatgcccacagaccactctaatcttggaaatgtttaaattgaggtttcttctcctgggtgaatgaataaatgaaataaaaaaaaa

SEQ ID NO: 17650 - DNA, 337 bp, Homo sapiens
gcgaggcagagaaacgctgatgtaaagatcagccccagttattaactgaaaacagctatttacaaagcagtaaatgcaagaaagaaaaggaagtcgcaaagagaaagtgatgcaatgcaaattgaggattttacaagatcagatactgctgctttaagtcaagggtgaataatctcaacaaacagcaaatagcaatcactttaccagctgcatattgcacccacataggtaactcttcattttaggaacaaactgaatttgaacactgagccttttgaactcagccatctctatatattctttccttaaaattcatgattttgggcaaaaaaaaaaa

SEQ ID NO: 17651 - DNA, 241 bp, Homo sapiens
tgcaatgtggatgttttacccacatgactgattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaaaaa

SEQ ID NO: 17652 - DNA, 362 bp, Homo sapiens
atttagcaaaatcaatgattaataaaatagttcatgattaaaagccttttcacatactaacactattatttcacaactttcttactggtgggccaaaataccaatatggtaaatggtgtgccagatgatattgtgggtatctaaattgaaaggtactatttcatataaaatgaagtcatgtaaatgtgggatcacagttcattgaattttaaaatctcaggtgaaccattatatttttcagtatttaatattgcttagtaaagacctagtccatgatgaagactgttttcctgcttgaagagcaagggaaaaagagcagttccttaaagcacgaacggggcttatgtccactctgcttcttt

SEQ ID NO: 17653 - DNA, 264 bp, Homo sapiens
gggaagtaagaggggtacagagcccggaatgcctgaaccaactgtaaagagcctactttggggataaaggaacatcaggtcccctggataaggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatggttttaacaggga

SEQ ID NO: 17654 - DNA, 107 bp, Homo sapiens
tatctctaattcacaagaaattgtattaggttcatggacaatggaaagaggattgtattgtaattagtaaccctgagttttagtattattttgttttttttttttat

SEQ ID NO: 17655 - DNA, 254 bp, Homo sapiens
tttcgagagctcagaggggggaggcagcagtgaggcgagattaggccattgcagtccagcctcaggaacaagagtgaaaccatgcctcaaaaaacaacaacaacaacaacaacaaaacttcctaggccagatgtggtggctcatatgtataatcttagcactttgggaggcaaggcaggaggattgcttgaggcgaggagttcaagaccagcctaggcaacatagggagacccccatctctacaaaaaaaaaaa

SEQ ID NO: 17656 - DNA, 106 bp, Homo sapiens
gaaagataggattggctatgcggggccccttgaattttagtatgaagtttaggaccagcttgtcaacatccgaaaaaaaaaaaaaaaaaaaaaaaaagagagtggg

SEQ ID NO: 17657 - DNA, 124 bp, Homo sapiens
gaggccaggagtccaagaccagccgggctaacaggggaaaaccccgtttctaccaaaatacaaaaaattagccaagcgtggggttgcgtgcctgtaatcccagctagtggggaggcggaagcag

SEQ ID NO: 17658 - DNA, 162 bp, Homo sapiens
taaaaacagcaataatttataatgaaccgaaaaccacaaactaaaccatggatattatcctagtatgggagacagaaaagataaaacactaagcaatagagaaagtaccgcaagggaacgctgaaagagaaatgaaataacccgtaaaaaaaaaaaaaaaaa

SEQ ID NO: 17659 - DNA, 435 bp, Homo sapiens
ggaagccctggaaaatcgcctgagatacagatgaagtttagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttcttgtagaacactggccataggaaatgctgtttttttgtattggactttacc

SEQ ID NO: 17660 - DNA, 102 bp, Homo sapiens
ttacctacgtcagcagtgggaactgcaacttggggctttgcgaataaaatttagctgccttgttgaaaaaaaaaaaaagaaaagaaagaaaaacaaaaagaa

SEQ ID NO: 17661 - DNA, 308 bp, Homo sapiens
gactctaatgggtacttgctcgtgcgttgcaacactgttttataatgtgcttcatttccttgctatttgatacatagttgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctaaaaaataaaaaaaaaaaaaa

SEQ ID NO: 17662 - DNA, 440 bp, Homo sapiens
aagcgagagcatgaagaatccaagagggtgctccaagaattttaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaaggcagtaaaaatgatactgaagaggaaagtaataaatccgcccaacagacaatgaaataagtaggactgagtatttatgtgaaaacgctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggctcattacagg

SEQ ID NO: 17663 - DNA, 434 bp, Homo sapiens
agcatcctctgccaagaccaaaaggaaagaagaaaattggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctata

SEQ ID NO: 17664 - DNA, 235 bp, Homo sapiens
acagataaacagaaaattaaatcagttttctaaacaggtatttttgaaaatccaataacaggttaacaaatttaaggtttatacaaatacagagaatatttttgacttaattttaattaaacttcatgaagtattcgattgataaatgggaatggaacaaagcattctctcagcattccaaatagcactgaaagatgttgatggcttaaaaaaaaaaaaggaaaaaaaaaaaaaa

SEQ ID NO: 17665 - DNA, 302 bp, Homo sapiens
taacaaactaggaggcgtcctggccctattactatccatcctcatcctagcaataatccccatcctccatatatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcctaaaaaaaaaaaaaaa

SEQ ID NO: 17666 - DNA, 217 bp, Homo sapiens
gatagaagaagccgcacgagagccagtatgagagtggcggggcgggcgccatgctccaagtcagcacccaaaggtcaatgcacagagaccccgggtgggtgagcagctggcttctcaaacggccgaagatgcctcttttaggaatctctttggaattgggagcacgatgactctgagtttgagctattaaaggacttcttacgcaaaaaaaaaaaaa

SEQ ID NO: 17667 - DNA, 142 bp, Homo sapiens
cggcagagatggaaaaatcagtatgctctatctgtagatagcatgtgtgtcctatacctataaatggcttttttgtggggcatttattgatcaaataatttatattttagactttgcatctaaaaaaaaagaaaaaaatttt

SEQ ID NO: 17668 - DNA, 439 bp, Homo sapiens
caatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagataggaaattggccttaattatataatcaatataaaatactaatgcaattctacagcattcaaatgaagaaacttgaggctttagggataagtgggtagggatattttaatggaaac

SEQ ID NO: 17669 - DNA, 156 bp, Homo sapiens
aaaaccataagatatctgggatttatcaaatgaatctgaatatatgttgattacatcacataacctctagaagggaaaaccaatatgttgtgtgcccagttatattagggtcaaatcaccagcccgtgaattgactaaatttttaactacttgctg

SEQ ID NO: 17670 - DNA, 257 bp, Homo sapiens
aacgctgctggaactgactcgttgcctcgattggccacattttgggactacgccaaggctgagctggttcctcccacccctgctgagatccctagagctattcagagcctgaaaaaaatagtcaatagtgctcagactggtagctacaaacagctcacaggtaaggaagctgtgctgaatggtttggtggccactgaggtgttgatgtggtttatgtcggagagattataggcaagcgggcatcattggctatgatg

SEQ ID NO: 17671 - DNA, 387 bp, Homo sapiens
gccaaaaatgaggctaagtgcatttactctcttcctggcattgattggcggaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagatcgaccatattgatgaaaaggcctttgagaatgtaactgatctgcagtgctcattctagatcacaaccttctagaaaactccaagataaaagggagagttttctctaaattgaaacaactgaagaagctgcatataaaccacaacaact

SEQ ID NO: 17672 - DNA, 302 bp, Homo sapiens
aagagcagtgtcactaaagtaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgtaagactgctgaagaattattttttttcttttataataaggaataaaccccacctttattccttcatttcatctaccattttctggtcttg

SEQ ID NO: 17673 - DNA, 385 bp, Homo sapiens
cggccgacatcgtctcttttttggccttggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacaagcccaagatagttaagtgggatcgagacatgtaagcagcatcatggaggtttgaagatgccgcatttggattggatgaatcca

SEQ ID NO: 17674 - DNA, 357 bp, Homo sapiens
taaatactgctatcattttctgaattacttgggatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagtgcttaactggagttttaatcctgggatatggacattggattcatgactgtgcagcattt

SEQ ID NO: 17675 - DNA, 149 bp, Homo sapiens
agcccaaagaggaacagctctttggacactaggaaaaaaccttgtagagagagtaaaaaatttaacacccatagtaggcctaaaagcagccaccaattaagaaagcgttcaggctcaacacccactacctaataaaaaaaaaaaaaaaa

SEQ ID NO: 17676 - DNA, 282 bp, Homo sapiens
tgttgtattatacttgtttttgtgtgtgcataaattcattctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagaatttgaagtttggctagcatccatacttttctactgtaaatatttcactctcctctagctatccttgatgagcttctcactttaagaataaatg

SEQ ID NO: 17677 - DNA, 370 bp, Homo sapiens
cttgacaaacccgatatggctgagaacagagaaaatcgataaggcgaaactgaagaagacagagacgcaagagaaaaatccactgccttccaaagaaacgatggaacaggagaagcaagcaggcgaatcgtaatgaggcgtgcgccgccaatatgcactgtacattccacaagcattgcttcttattttacttctttgagctgtttaactttgtaagatgcaaagaggttggatcaagtttaaatgactgtgctgcccctttcacatcaaagaactactgacaacgaaggccgggcgtgcctttcccatctgtctatctatctggctggcaggggaaggaaagaacttgcatgttggggaaggaagaagg

SEQ ID NO: 17678 - DNA, 378 bp, Homo sapiens
gaggcatgaagagtgtaccttatgaggcaggagttcaataccagcctgatcaacatggtgaaaccatgtctctactaaaaatagaaaaattacccagggtggtggacgcacctgtaatcccagctactcaggaggctgaggcaggagaatcacttgaacctgggaggcagaggttgcagtgagccaggattgtgccattgcactccagcctgggtgacaaagcaagattccatctcaaaaaaaaaaattatttttttaaaaggataaacaacattgacaaacaaaaggaaacatgacaactgataccacaaaaactcaaaggatcactagtggctattatcagcaactatatgcaaacaaatgggaaaaaaaaaaaaa

SEQ ID NO: 17679 - DNA, 318 bp, Homo sapiens
tgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttatttttttttaaagaaaagatgaaaggcagcctatttcatcacaagaacacacacatatacacgaatagacatcaaactcaatgctttatttggaaatttaggggttttttatttctaccgcaaatgatgtgcaaaaccttttactgg

SEQ ID NO: 17680 - DNA, 158 bp, Homo sapiens
ggagtgacgtatagaggatgcccctgtaccctaccacacattcgaagaacccgtatacataaaatctagacaaaaaaggaaggaatcgaaccccccaaagctggtttcaagccaaccccatggcctacatgactttttgaaaaataaaaaaaaatgaa

SEQ ID NO: 17681 - DNA, 188 bp, Homo sapiens
acttgttcatgagcactgaaatcctgaagaggagagatttggatataaactaaaaaggttgggtgagcttaagtgcctcagttaatgcacgtacagtattcatttggttggttgtactacctctcagaagtaaaatttgtcaccttatggaatgagagtttttgggtttgggggaagtttttttgttg

SEQ ID NO: 17682 - DNA, 288 bp, Homo sapiens
gagaaacacagggcgacctcgccttttatccaagcaggaagattctatatcctgatggtagagacagactccaggcagccctggacttgctagcccaaagaaggaggatgtggttaatctgtttcacctggttgtcctaaggccatagttaaaaagtaccagctctggctggggtccgtgaagcccaggccaggcagccaaatcttgcctgtgctgggcatacaaccctctgctgtcacatctctgagctatatcctcattagggaaggtggcttttgctttataggt

SEQ ID NO: 17683 - DNA, 226 bp, Homo sapiens
  misc_feature 6, 12, 22, 47: n = A,T,C or G
aatcancctatnaaagcttcanaaactttgggcgggtgggattaagnacaagcacatttggcttacagtaaatgaactgatttttattaactgcttttgcccatataaaatgctgatatttactggaaacctagccagcttcacgattatgactaaagtaccagattataatggccagaatataatgtgcaggcaatcgtgggatgtctctgacaaaagtgtgtct

SEQ ID NO: 17684 - DNA, 255 bp, Homo sapiens
  misc_feature 33, 40, 56, 86, 97, 164, 185: n = A,T,C or G
aggttttcatgcgagctgaatggaaaaaacatngaagcgncgttgcccagggcatnggcaagcttgccagtgtacctgctggtggngctgtagccgnctctgctgccccaggctctgcagcccctgctgctggttctgcccctgctgcagcagaggagaagaanagatgagaaagaaggaggagncttgaagagtcagatgatgacatggggatttggcctttttgattaaattcttgctcccctgcaaataaag

SEQ ID NO: 17685 - DNA, 280 bp, Homo sapiens
  misc_feature 31, 88: n = A,T,C or G
ttcattctcgctaacaactgcccagctttgngaatctgaaatagagtactatgctatgttggctaaaactggtgtccatcactacagnggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttggc

SEQ ID NO: 17686 - DNA, 197 bp, Homo sapiens
  misc_feature 10, 11, 149, 178: n = A,T,C or G
tatatgtgannatatatacatggcaatagctcagaaggttggggtggggtgggggaatttattggagttatattgctgcaagtttaccatattttacctgaaacaacttagattattacccctaagtggactgcaatgagatttatagngtaatcccactaaaatataatgtggaganggattgcctgaggccagga

SEQ ID NO: 17687 - DNA, 190 bp, Homo sapiens
tccggaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgagggcgtgcgccgccaatatgcactgtacattccacaagcattg

SEQ ID NO: 17688 - DNA, 244 bp, Homo sapiens
  misc_feature 52, 54, 127, 170, 198: n = A,T,C or G
ttctgtattgcgccgctagaggtggaattcttgggccggcgcaagacggaananagcgaaagcatttgccaagaatgttttcattaatcaagaacgaaagtcggaggttcgaagacgatcagatacncgtcgtagttccgaccataaacgatgccgaccggcgatgcggnggcgttattcccattgacccgccgggcnagctttccggggaaaacccaaaagtccttttaggggttcccggggg

SEQ ID NO: 17689 - DNA, 124 bp, Homo sapiens
  misc_feature 47, 66: n = A,T,C or G
ttattttcctagaatccccaaagagcagtggcagtccatggcttggntgaagctagaaattttccngcccctggggacctggtaagcctcctgctcggaaccgtgtgagtgtggtgaaagaaga

SEQ ID NO: 17690 - DNA, 237 bp, Homo sapiens
  misc_feature 11, 22, 33, 221: n = A,T,C or G
acatttcaggncttcctccttnccttacggaantcatttgatggcaacaaaatcagcagagttgatgcagctagcctgaaaggactgaataatttggctaagtaataatattctttcatgacattctatcagaacaatggctaggtatattagtgcttatatgataaggaattataaacatgatgattgattttttggagtgtactacatttcactgctgntgttgtttctattaat

SEQ ID NO: 17691 - DNA, 108 bp, Homo sapiens
  misc_feature 5, 8: n = A,T,C or G
tggantgntgcttctattttgttcatcaaaaccaaacagagtggaggttgctctggggctggatggatggccagtcattaaaatcaatgccttacaaaaaaaaaaaaa

SEQ ID NO: 17692 - DNA, 260 bp, Homo sapiens
  misc_feature 10, 19, 31, 42, 190: n = A,T,C or G
taataccatntagaagggnaatgtttagatnaaaatgaaggngactgaaacagcttaaagtttagtttaaaagttgtaggtgattaaaataatttgaaggcgaagaaaagaatagagaagatagggaaattagaagataaaaacatacttttagaagaaaaaagataaatttaaacctgaaaagtagganagcagaagaaaaaagacaagctaggaaacaaaaagctaagggcaaaatggtccaaactttagaagaaaat

SEQ ID NO: 17693 - DNA, 226 bp, Homo sapiens
cttggacacttaattctgttctgatattaatttatcagattgcttttgtgcattggataacaccaccattcacaagttaagattcttggtatttggatatctgttagatgctactaagaaaatagaagatgagctttctttttaaagcttttgatgtggtgtcatagaatagcatgtttgtagatacaatcagctgcttttgttacccttaaaaactagggcattt

SEQ ID NO: 17694 - DNA, 218 bp, Homo sapiens
  misc_feature 21, 51, 55, 58, 84, 131, 132, 142, 150: n = A,T,C or G
ggcacagataaagcagaccancttggtgagaaatggaatgagccctctgtnactnagnaaaagcaagaatgggccaggcgcagnggctcatgcctgtaatcccagcactttgggaggctgaggcgggcggnncacctgaggncaggagtncgacaccagcccggccaacgtgatgaaacctcgcctctactaaaaatgcaaaattgactgggcatggg

SEQ ID NO: 17695 - DNA, 198 bp, Homo sapiens
  misc_feature 7: n = A,T,C or G
gagcatncatagatgtgagttttttcccccaagtactctaagtgatgaaattatgtaccttttgcaggtggagcctccactttcttaggagcaggaactggcaccttcttctcaggcacaggcttcttgggtacctctggcactttaacgaaatgatttagagaaaaaattttataccgacataaaaaatactgattc

SEQ ID NO: 17696 - DNA, 222 bp, Homo sapiens
  misc_feature 146, 157, 167, 177, 212: n = A,T,C or G
ccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccncaggggttggncaattttcgngccagccacncgcggtcacacgattaacccaagtcaatagaagcngggcgggaaa

SEQ ID NO: 17697 - DNA, 263 bp, Homo sapiens
  misc_feature 13, 252: n = A,T,C or G
tcatcgtaaaatnccagcattttggaaggctgaagtgagaggatcacttgagaccaggagttcgagaccaacctgggcaacagggagacactgttcctacaataaataaataaataaatatttaaaaattagccaggcatggtggtgcatgcctgcggtcctagctactcaggaggctgaggtgggaggatcacttgagcttgggctgtcaaaggctgcagtgagccattactggggccattgcacctcccnattccctgggg

SEQ ID NO: 17698 - DNA, 201 bp, Homo sapiens
  misc_feature 6, 23, 140, 174, 177, 186, 192: n = A,T,C or G
aagaancggcttttagcacgagnaccaattcctagttaatgtagaaaacgcccaggatgctataaaatcaccacggtctttagatatgcagaaacgggaggtttgtgagttggctgctccactgtcctctgccagcctanaggaggaaaagcaagggttacagaaggatgttcnttnaggaggaancagcantaaaagcac

SEQ ID NO: 17699 - DNA, 280 bp, Homo sapiens
  misc_feature 15, 195: n = A,T,C or G
cataaaaactcattntggttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatanggggggagaatatgatactttcacattaatatacctatggaaccctggttcatattaacctcctggaatttggactactaacctt

SEQ ID NO: 17700 - DNA, 211 bp, Homo sapiens
  misc_feature 7, 17, 36, 39, 69, 183: n = A,T,C or G
gcggacnagatgttttntttttgaaagatggagatnaanacaactacttaaaaaatatagtcaataggntactaagatattgcttagcgttaagtttttaacgtaattttaatagcttaagattttaagagaaaatatgaagactttagaagagtagcatgaggaaggaaaagataaaaggtntctaaaacatgacggaggttggagattg

SEQ ID NO: 17701 - DNA, 165 bp, Homo sapiens
  misc_feature 35, 93: n = A,T,C or G
gaaatgtccatcaaacaaaatacggtgtctgtggnccaagctactcgggaagctgaggttaggagaatgacctgagcccaggaggttgagggngtggtgaactatgattgtgccactgcactccatcctgggtgacagtataagatcctgtctataaaaaaaaaa

SEQ ID NO: 17702 - DNA, 269 bp, Homo sapiens
  misc_feature 13, 24, 51, 193: n = A,T,C or G
ttctaagaatttnatctgttttgnactttagaaatgtcagttgctgattcnaaactgtttatttgcactatgagcctatagactatcagttccctttgggcggattgttgtttaacttgtaaatgaaaaaattctcttaaaccacagcactattgagtgaaacattgaactcatatcttgtaagaaataaagnagaagaattatttagtttttttaattggtattttaatttttatatatgcaggaaagaattaggaagtgattgaata

SEQ ID NO: 17703 - DNA, 201 bp, Homo sapiens
  misc_feature 23, 37, 112: n = A,T,C or G
attgaccaccatctcagatgggntcacctgtggaagnagaacagggtctgaaacccctcaagcaccaatgagtggtgtaggtcctgtgagtggaggtcctggtggctttggnagaggaagtcaagggggcaactttgaaggccctaataagcgtcgtagatattaaacattcgttcattcctggctatctagaaaaaaaaa

SEQ ID NO: 17704 - DNA, 179 bp, Homo sapiens
  misc_feature 6, 15, 24, 124, 164: n = A,T,C or G
aagttnttaaaaganaattgaganaaaggactacagagccccgaattaataccaatagaagggcaatgcttttagattaaaatgaaggtgacttaaacagcttaaagtttagtttaaaagttgnaggtgattaaaataattttgaaggcgatcttttaaaaagnagattaaacccgaaa

SEQ ID NO: 17705 - DNA, 231 bp, Homo sapiens
  misc_feature 12: n = A,T,C or G
catctaaatgantcccagctgaggatggaaaattgcaacactactggtcctcctgatgtcaactgacaaaggataagatacttaaactttgctttccttgacatccttttcagtgagagttctaacaaagagagaataataattaatatacagatctataataactgtgatagttttcttgtgggtttatacataaattgttttaattagcctctaccaggctactatggg

SEQ ID NO: 17706 - DNA, 207 bp, Homo sapiens
  misc_feature 23: n = A,T,C or G
cttgatgaatcatggacggaccngcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaagggagttcatgt

SEQ ID NO: 17707 - DNA, 297 bp, Homo sapiens
  misc_feature 16, 22, 66: n = A,T,C or G
tgaaaaaatatgaacntatttncatttgtacaaggtaattgttttttaagcaagttaccttagggnggctttaattgtataagtcaagcacatgtaataaattcaaaacctgcagttaacaggatattagacatcaatcctggtaaccaaatattaaagattctctttaaaaaagactgaacatgtttaccagggttttgaattaggctaaaaagggctttggcagtgggcttttttcatgggcccttcaaattgggaaatgggaacctactggtactttggcccattttttaaaaa

SEQ ID NO: 17708 - DNA, 162 bp, Homo sapiens
  misc_feature 20, 25, 62: n = A,T,C or G
tatcttgtgggaaaattggntggcnaataattttagatatcacacagaaagttagtggggantgtaatatttggattaacatttacttgagaattttatggtaaattttttgaccaaagacatagtaatagcttctaaggaagtgacctatattaatcattt

SEQ ID NO: 17709 - DNA, 221 bp, Homo sapiens
  misc_feature 29, 43, 46, 192: n = A,T,C or G
actctcaacaatacagctgacctctcggncctggctcaacagngantccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaanagaaggccatatcatgggatgaatgatgt

SEQ ID NO: 17710 - DNA, 198 bp, Homo sapiens
  misc_feature 11, 12: n = A,T,C or G
aggggggggannataggtgtgagccactgcacccagcctacttcactcttctgaattattctgatttattttcaacaacttttgtgaacttgcccgtgatacaaagcagatagtccctgaaccacagtcgtgcctccttgaaacaagccattctactgtgctaatgttttaatatcacatctcacaaataacaggggg

SEQ ID NO: 17711 - DNA, 217 bp, Homo sapiens
  misc_feature 9, 137: n = A,T,C or G
tgttttctntttgaaagatagagattaatacaactacttaaaaaatatagtcaataggttactaagatattgcttagcgttaagtttttaacgtaattttaatagcttaagattttaagagaaaatatgaagacttnagaagagtaggcatgagggaaggaaaagataaaaaggtttctaaaacatgacggaaggtttggaggatgaagcttcttca

SEQ ID NO: 17712 - DNA, 251 bp, Homo sapiens
  misc_feature 31, 37, 50, 225, 247: n = A,T,C or G
tcaagaacaatgattttgtcttgactgagtnttcttnaacttctttgagnttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattggagnagcaaacacctgatgatcttancggg

SEQ ID NO: 17713 - DNA, 185 bp, Homo sapiens
tataatcagctcaatgctggtttatggagcaatttcttatcaagtgggttggctgattccattcttctgttaccgactttttgacttcgtcctcagttgcctgggttgctattagttctctcacctatttgccaagaatcaaagaatatctgggatcaactaccttgattttccctacaaaagat

SEQ ID NO: 17714 - DNA, 255 bp, Homo sapiens
  misc_feature 30, 36, 41, 43, 56, 65, 69: n = A,T,C or G
tgaagctgacagcatttgggccgagatgtntcgctncgtgncnttagtgtgctcgngctactctntctntctggcctggaggctatccagcgtactccaaagattcaggtttactcacgtcatccagcagagaatggaaagtcaaatttcctgaattgctatgtggctggggtttcatccatccgaatttgaaagtttgacttactgaagaatggaagagaagaattgaaaaaaagtgggagcattcaagaactt

SEQ ID NO: 17715 - DNA, 191 bp, Homo sapiens
  misc_feature 30, 32, 81: n = A,T,C or G
gcagccaaatgctcattaattgtattttgngncaagatcaattgctctggaaaggtaaatgtatcttgagagtaggagagntctagcaaatcttactaagagtatcagagttcatgtctcagtgaaatgctttgaatgtgtcaagtttaaaaacaggagcagtgatttttaaagattcctttaagccctaa

SEQ ID NO: 17716 - DNA, 208 bp, Homo sapiens
  misc_feature 8, 11: n = A,T,C or G
ggcaattnganaatgaaataattgaatgtaaatattgggaaaagtataaaattatctctttgtgcgaatgatatgattgtacacctagaaaaccctagtaaaaaactactaggattaataagagaatttagtaagataactaaatacaagataaatatacaaaagtggaatggccattctcttgccataaaaaatagcctgttagaat

SEQ ID NO: 17717 - DNA, 204 bp, Homo sapiens
  misc_feature 33, 56, 59, 101, 116, 117, 129, 135, 141: n = A,T,C or G
tgtctgtaaaaaacagataataaataaagaagnaacttgcttgaggtcacagaganagngactgataattattactgtagtacttttatgtaagaggcagnattgtataagtggannaaaagtgaaggntctggncctggngcgggtggctcacccctgtaatccccagcacttcggggaggccaaggcagggtgtatcaccag

SEQ ID NO: 17718 - DNA, 101 bp, Homo sapiens
  misc_feature 10, 60, 81: n = A,T,C or G
gatgagccgnaccgcacgacaccctcaaagactctcccgtggatgacggatgaggactcngggctgctggaataggacacncaagacttttgactgccatt

SEQ ID NO: 17719 - DNA, 253 bp, Homo sapiens
  misc_feature 8, 18, 143: n = A,T,C or G
gaacgccngaggagatgnctaggcttaaggccatcagtgataggtaactgaaggagaaacacttggaaaagcgaatgatgcggactgtgactccttagtgttgaagtctagtattggtggattagtctggagggtagagaagnacaggctccacctcatttctgtgagttgtagccacaacagctctttgcctttctttcatatcctaatattttacagtccctttccctggcctgggaaaggccagggtggg

SEQ ID NO: 17720 - DNA, 231 bp, Homo sapiens
  misc_feature 18, 20, 145, 215: n = A,T,C or G
atggagtctacttacacntntctagatggtataactgactgcacacctagctatagggtatagcttattgctcttaggtcacaagcctgtacagcatattactctactgaatagtgtaggcgattgtaataccatggtaagtatnttgcgtatctaatcatatcaaatagcaaaaatttggtattataattttaaatgagaccactgtcgtatantggaggtccatcatta

SEQ ID NO: 17721 - DNA, 216 bp, Homo sapiens
  misc_feature 20, 25, 26, 41, 52: n = A,T,C or G
tgtgccttttatatcctagntatgnnccacttgttctaagngcaatcctttnatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattat

SEQ ID NO: 17722 - DNA, 186 bp, Homo sapiens
  misc_feature 12, 37, 38, 157: n = A,T,C or G
gaggtttatatnataaagatatatgtgttcatgatgnngaaattgcttccatagaaattttcccactgatagttgatttttgaggcatctaatatttacatatttgccttctgaactttgttttgacctgtatcctttatttacattgggcattgtnctatacgtgagaccagggctatcacttcc

SEQ ID NO: 17723 - DNA, 122 bp, Homo sapiens
  misc_feature 26, 35, 37: n = A,T,C or G
ctgtttctgatgcttgttttcttttnagactgttntngtcttttagcatgccttgtaattttttgttgatagctagacatgatgtattgcataaataaacaagtaaactaagaaaaaaaaaa

SEQ ID NO: 17724 - DNA, 249 bp, Homo sapiens
  misc_feature 24, 51, 71, 149: n = A,T,C or G
tgaaagttacgagaacattatgtntgtatcatttctttcataaaacctcanggcatttttaagcccttttnatcagacccagtgaaaactaaggatagatgtttaaaaactggaggtctcctgataaggagaacacaatccaccattgncatttaagtaataagacaggaaattgaccttgacgctttcttgttaaattagatttaacaggaacatctgcacatcttttttccttggggcactatttgg

SEQ ID NO: 17725 - DNA, 158 bp, Homo sapiens
  misc_feature 10, 34, 128: n = A,T,C or G
ccagcgagcncaccctctaaatcaccacgatcanaagggacaagcatcaagcacgcagcaattgcagctcaaaacgcttagcctagccacacccccacgggaaacagcagtgattaacctttagcaanaaacgaaagtttaactaagctatactaacc

SEQ ID NO: 17726 - DNA, 223 bp, Homo sapiens
  misc_feature 25, 40, 49, 58: n = A,T,C or G
aagtttgataccaaaatgaaacagntttggagggatacgntaggagccnggaagccanttttgtaattttgttgtctgtataaatgctacctttgcctggaggtagtgcgcctgtggctgtgtacatccagagggcaacagtaatagccaacaaccagacaaactagtgaagttaatctgtggagtgactgattttatgatacttatattgcaaattaaaggc

SEQ ID NO: 17727 - DNA, 171 bp, Homo sapiens
  misc_feature 107, 117, 134, 140: n = A,T,C or G
agattaatacaactacttaaaaaatatagtcaataggttactaagatattgcttagcgttaagtttttaacgtaattttaatagcttaagattttaagagaaaatantgaagacttnagaagagtagcatgagngaaggnaaaagataaaaggtttctaaaacatgacgga

SEQ ID NO: 17728 - DNA, 203 bp, Homo sapiens
aaagatgaagagctgctggggccagaaatgcttaattaagatctgtcttgtttttgcaagggataatttacagccaccggtatggccctggcctctggccttcaaaggtgactgacattctatcagtgtcatttgaaggaaagcatatcaacctaaaaggcggatataaaggggaagtaacaactcatcagaattatgcattg

SEQ ID NO: 17729 - DNA, 228 bp, Homo sapiens
  misc_feature 70: n = A,T,C or G
aaaaaaacatttggaaaaattcatttataaaagcaagttgataccattgggagaaatttctctttcattncccttctaggacctattgctattttttattcatttattcatccaagaaacttttattacatatcctttatttgcctagcatcatatcaggtataaacaaaattttaataatggcagagtatttgatcttatagaagcttacagcctctgaaaagggtg

SEQ ID NO: 17730 - DNA, 252 bp, Homo sapiens
  misc_feature 129: n = A,T,C or G
atctgtttgcaaactgctgatttttcgagaatcatccccataaacttctcataaagcatcaatgattttaccattcttccacccaagcttcacactaaatttgatgtttggttttgcttcaattttagnagaatttatgttgctctgacaggtgctcttttcaaacttacgtcttacctttttagtgcctcaaactacatcctgttcaggcatgttataacaaggtaagtatggagccttattttttgggga

SEQ ID NO: 17731 - DNA, 138 bp, Homo sapiens
  misc_feature 14, 34, 42, 50, 62, 96, 98, 110: n = A,T,C or G
taaattaaagcctntagtttcagcgttttaaatnctgagacntgtgcaanccctgtgtggangcctgtggaagagtgtgtgtgtgtgtgtgtgtgngngtgtgtgtgtgncagagagagagagagagagagagagaga

SEQ ID NO: 17732 - DNA, 185 bp, Homo sapiens
  misc_feature 9, 13, 116: n = A,T,C or G
gcgcatgtnagcnggcctttatcaaactgcttctataaactcaaaggaaggaaaactacttttaagaaataaaaggtaagtgaatgtgcaatcagaatttaattttgtgcaggatnttaagtgcatttaaactagaaacaaaaaatgacattatcagaaagccagattaagggcaaaaaggttag

SEQ ID NO: 17733 - DNA, 247 bp, Homo sapiens
  misc_feature 10, 37, 50, 58, 186: n = A,T,C or G
gacctttggnctaaagctgggagactgaaaaaatganaggccggggcatnattcattnctccagctctgatccgctgttgtaccaggggtctaatcaggcctgtgtctgcctccttcttgaatagcccagtgaattcatctaaacagccttcctacagcaacttcccactccaggtggccagacgnggagttccagaccagttgttgtcttcccgggacattgacacagcagccaagtttatttggt

SEQ ID NO: 17734 - DNA, 289 bp, Homo sapiens
  misc_feature 28, 202, 225: n = A,T,C or G
aatttccagtttttagtaattgcctacnacaaaaagaaattttgctggcattttcagaatcatcttttgaagctttctgttgatgttaactgagctactagagatattcttatttcactaaatgtaaaatttggagtaaatatgtatgtcaatatttagtaaagcttttcttttttaatttccaggaaaaaataaaaagagnatgagtcttctgtaattcattgnagcagttagctcattttgagataaaagtccaaatgcccaaacactagcctctggtatttaaatc

SEQ ID NO: 17735 - DNA, 146 bp, Homo sapiens
  misc_feature 6, 19: n = A,T,C or G
tattgnagaaaaagaccangaaattaaacacctgaagcttaagtcccaacccatagaaattcctgaattgcctgtatttcatctaaattcttctggcacaaatacttgaagattctgaacttaccgactggctgagagtggaatgg

SEQ ID NO: 17736 - DNA, 232 bp, Homo sapiens
tctattgattcagtagacaaattccaaagaaaggctacaaatattttgagtaatgacagtcatttttgaaataggtgtacgggtccttcaaggaatagctcaaataaactactccacaaagctttctatgacctttctaccctttcccctaggtaagaagtaatttttgttttttctttggatataaaccttgatatacccttgtaccttttctgattattagtaactcctt

SEQ ID NO: 17737 - DNA, 125 bp, Homo sapiens
  misc_feature 20, 24, 32, 61, 77, 88: n = A,T,C or G
ggaactagcacctactgtgncctnaacaccgngccacctatagaagatgatcatgggaacngcaatagtagtcatgnaaaaatctttntaccgaaaaagctgcttgaatgtctgccgaaatgttc

SEQ ID NO: 17738 - DNA, 532 bp, Homo sapiens
gccgagatgtctcgctccatttccttagctgtgctcgcgctactctctctggctggccttggaggctatccagcggactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttggactacactgaattcacccccactgaaaaagatgagtatgcctgccgtgtgaaccatgggactttgcacagcccaagatagttaagtgggacgagacgggtaagcagcatcatggaggtttgaagatgccgcatttggattggatgaattccaaatctgctgcttgcttttaatattgatagctatacactacctttatgcacaaaaggagggtaataataaggtaacatggacaggacttcttaaaatccacttgggggcggccccatgt

SEQ ID NO: 17739 - DNA, 532 bp, Homo sapiens
gcggcggacatgtatgtggtgcaaatcagatttcagtctaaagcgaaacatcaataagttaataataaacctatcttttgggaagttgaatattaatctgtacccaaaacgtatttagtaaaatatttgcccccgcaccctgccatgctgacataacaacttttataatgttgaatagatgatatgggaaatactaataacaacaatgtaatttttgcagacagctttaacttatatacattggttgatttttttcaaaagactaaatatgcatttatactttggttattttctaccaaagaaggttgtaaaaatatgcctgctgcttttccttttgaaggacacaaacctggcccaacatgggtggattttaaccctgggtgggggcattaaatcaaaagagagaggcagaagatgaaatgctaaagaagggcaggcaacttctgttcaggataaaatcatcagcaggcctctgagtgaaaagaaagatttggaacccctactggatggccgggtacacaacacacaccac

SEQ ID NO: 17740 - DNA, 349 bp, Homo sapiens
ctatctagaactggtcggccttttagtctactgtaacgaatagaagaaacgaggaatgttcacaaaggatttatttgaagtgacactgggaaacgatttttagaatttgaagctctttggtccctgtgaatctaactttatgactattttattcagctaatctttgagaatatttagagttttgatttgcgtgcactctgcttttaatcccttggtgaataagtggtagaaaccttgatcttggcctatacctgatcacctctaaaaacatgaacagggtacaaaggcagttgtttagtaagcttttttggattggtttaattggctgactgagggagacaaaattagg

SEQ ID NO: 17741 - DNA, 600 bp, Homo sapiens
tcgggcctgagatgtgtcgctccgtaggtcttagctgtgctggcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttggactacactgaattcacccccactgaaaaagatgagtatgcctgccgtgtgaaccacgtgactttgcacagcccaagataggttaagtgggacgagacatggaagcagcatcatggaggtttgaagagccgcatttggatgggatgaattccaaatctgctggctgctttttaatatggaaatgcttatcacttacactttatgcccaaaatggaggggtataaaaatgtaacatggacaggacctctttaaaaatccacttggagggctggccccaggttggagggaccgaacaggtggctccaaaggagccttaggagggcgggaacttaaa

SEQ ID NO: 17742 - DNA, 195 bp, Homo sapiens
  misc_feature 27, 28: n = A,T,C or G
ttgaaatctgaattaaaaagattttgnnccacggctatccagggcaaaacagagtaggaccacattaatccttgatagtagctctctttactcttcctagatttactcttagatctgtacttctgaatagtctttactttcttaatcatatgacctcctacaataaaggttttttgtttttattttgggggtttt

SEQ ID NO: 17743 - DNA, 267 bp, Homo sapiens
  misc_feature 15, 20: n = A,T,C or G
gacaactatgctaanattanttcaaaatagattttaaatcaataaaggtgaagaacaaaaacaatgtatattaataaaatgttcagtactgcaaggagattacagttataaatgcttatgcatctgctaacagaccatcaacatacataaaacaaagattaacagaactgataggagaaatacatagttctgcaataacagtgggaaacttcaatacttttcctctcaatactggatagaacaacccttgcagaaagcagaatgggg

SEQ ID NO: 17744 - DNA, 111 bp, Homo sapiens
  misc_feature 31, 41, 106: n = A,T,C or G
tgcataccctgcttgaaataccagatagcgntcaaaacctntaaatgtgtatgtgttgttgttgtttttttgtttttttttttttggccttgggaagacctgtttngcaaa

SEQ ID NO: 17745 - DNA, 219 bp, Homo sapiens
  misc_feature 142, 144: n = A,T,C or G
gaggtaccagagaaagcacctccttcccagagaaagcacagctcagaaaagagggccaccaggttcttggtgcttccttcagcagctggtggtctaaagtcctcaggcagacagtgccactgtgccccctggtgggatgggnanggcaagttgtcaggtgtgaagtggggcagcacacttgagctcagagtcaggacaatctacatctacatcttcatt

SEQ ID NO: 17746 - DNA, 124 bp, Homo sapiens
tttggaagaggagccattccctacagtgcatccgggagggccggcgtgggtatgcagggactgtgttattcattggacatcttagatagtaattgttacagaagatgaaaccaatgtgccagag

SEQ ID NO: 17747 - DNA, 261 bp, Homo sapiens
  misc_feature 17, 24, 45, 232: n = A,T,C or G
aaattgcaatattatgngataagntctttaaaagaggtaagaganggtgctttgggagcagagaagagggagaaagcagcatcttgcctggttgtgaaaatacatgagataaatcatgaaggccactatcatcctccttctgcttgcacaagtttcctgggctggaccgtttcaacagagaggcttatttgactttatgcttagaaagatgaggctttctgggataggcccnagaaagttccttgatgaccgcgactttcg

SEQ ID NO: 17748 - DNA, 239 bp, Homo sapiens
  misc_feature 16, 31, 42: n = A,T,C or G
atttggtattcctgtnggatgactgcaatgncttggaatccnatcccagtgactacggtcctgccagatcgtcagcgctaagggaactgagaccagagaaagaacccaagagaactaaagttatgtcagctacccagacttaatgggccagagccatgaccctcacaggtcttgggtaagttgtatctgaaaactggttatgtatctctctaccttctgggaaaaacaggggctgggta

SEQ ID NO: 17749 - DNA, 191 bp, Homo sapiens
  misc_feature 31, 39, 48, 68, 94, 124, 140, 153: n = A,T,C or G
acagcattgctaatagaatttacctggcccnaactaatnataacaacntctaaatcctagaagacagngaataaaaccctacaacaccttcctncattctcaaacactacttgacagataagtngcttacaaaattagtnctactcggttttngctttcacgcagtttcccaggtttcttgcctaactagt

SEQ ID NO: 17750 - DNA, 196 bp, Homo sapiens
  misc_feature 20, 21, 176: n = A,T,C or G
aaaaaagacaattactactnnctgagattatgaacaaacctgaagagcagtgaaccaaaagacagagctactaattctaaagcgacaactcctaaacctcaaaagccaaccaaagcacccaaaaaacccacttctaccaaaaagccaaaaacaatgcctagagtgagaaaaccaanagacgacaccaactccccga

SEQ ID NO: 17751 - DNA, 237 bp, Homo sapiens
  misc_feature 58, 177: n = A,T,C or G
tatactaaatacatttcatgggctggatgccggaggctcatgctgatcccagcacttngggaggctgaaggaggatcacctgaggtcgggagttcgagaccagcctggccaagatggtttagtagaaaccccatctctgctaaaaaaatacaaaaattagctgtgtgcggtggcacncacctgtaatccaggctacttggggaggctgaggcaaagaggattccttgaacctgggga

SEQ ID NO: 17752 - DNA, 575 bp, Homo sapiens
  misc_feature 43, 44: n = A,T,C or G
ttaacgagcctggagcagaggttcaacgggacaacgaatacgnnggaagctgagcaaaactaaccctgctgaccctggtattgtgtataattaatatttgtgtctcaattgatagcaaaatagtttatgggtttggaaacttgcatgaaaatattctagccccctcagatgttcctgcagtgctgaaattcatcctacagaagtaaccgcaaaactctagagggggagttgagcaggcgccaggctgcatcaacatggatatgacatttcacaacagggactagttgaatcccttggaacggagtaggtgctgctctttgccatgtgtaatgaggactgcaaaggcccttctggtgggattcctaggacttttcctcaagaggaaatctggatttccacctaccggttacctgaaatgcaggatcacctacttactggattctacattattatatgacataggataatgagacaatatcaaaaggaaacatggaatggcaatacatactaacattcttggaggaggggtaagagaaccgaggcctaattctacaatccggcaatagcattaacaa

SEQ ID NO: 17753 - DNA, 610 bp, Homo sapiens
  misc_feature 2, 3, 7, 11, 12, 13, 14, 15, 16, 21, 24, 28, 37, 54: n = A,T,C or G
gnncggngggnnnnnnggggnatntccnaatgaaagnctctgagataacggggnattagcccagtcagagtgcgtcaggtgcatagcctatgctcggagtctagcttttgatgggggctggagtgggcactgacgaaccttggggcatgtttgttcttggggcattccagggggggaactgtgatctaacccaaccctgccattttacagatgagacacatctgcatttacatatcgagacccagagaggtaaagtagattgttcaaggttacacagtgaattagtgacattatgataaatagaatttgagcatttcagaaactggagtttaatataacttctcttttacattgcatgcctcattatgttgttcttacagtacattagaacttttatagggcacgtttttccaaaaggtttacctctgccatattgtatatggagaagtatgattaatattagtaaattatagatatatctcttttggacaacctaaagaataaaaggctcttttaaaccccaaattcaagttaaaaattaaagacacgatgctaaaaatagtctaacatatgtaaaaatgatttaaaaaatttattacacaaggaagta

SEQ ID NO: 17754 - DNA, 130 bp, Homo sapiens
tgagaatgacttgaacccaggagcagaggttgctcttgagccgagatcgcgccattgcactacagcctgggcgacacaacaagacactgtctcaaaaaaaaaaattaaaaaatataaataagtaaaaatt

SEQ ID NO: 17755 - DNA, 527 bp, Homo sapiens
aaaaattgggtcttttggcatgaatttataattcctaaatgttagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgcccatcgggatataaatgaagcagatttgatttttggattcttacgtttctctgctttgtaggttggggctggacttaaagaaatacagaatttcatatatttaaaaatggttaaaatgggcccacagacattgtaaatgattaaaaactaacatgaaaatattacacctaaaagaatcttaacttcacaagggtttacttcgacgatgtgcctttgatttaatttgggcactttttagaaggtacatatcgggttgcacggctttgagagctgggaataaaattctgctaattatccaaaaggaaaaaaaaaaaaaaa

SEQ ID NO: 17756 - DNA, 262 bp, Homo sapiens
  misc_feature 172: n = A,T,C or G
taaaaagaaattttgcctgtcattttcagaatcatcttttgaagcttctgtgatgttaactgagctactagagatattcttatttcactaaatgtaaaatttggagtaaatatatatgtcaatatttagtaaagcttttcttttttaatttccaggaaaaaataaaaagagnatgagtcttctgtaattcattgagcagttagctcattttgagataaagtcaaatgccaaacactagcctctgtattaatccccatcatta

SEQ ID NO: 17757 - DNA, 280 bp, Homo sapiens
  misc_feature 34, 69: n = A,T,C or G
aacactaaaagattattccttgtttatctgaagntcaaataattaactggatgtcctatatttttattngctaagtctggtacccataagccagatataagcaactggtcagacaattgtctatatttttatttgctaaatctggtaaccctaaacctggtataagcaactggtcagaaaattaccaagagctcacttctgaagaagagagtgtatttcagaaaaaagtggggctggggcacataccaaaggatgtttgcaggagcaaatattaagggat

SEQ ID NO: 17758 - DNA, 218 bp, Homo sapiens
  misc_feature 30, 184: n = A,T,C or G
taaccaagatgatatagcaaggactaaccnctataccttctgcataatgaattaactagaaataactttgcaaggagagccaaagctaagacccccgaaaccagacgagctacctaagaacagctaaaagagcacacccgtctatgtagcaaaatagtggggaagatttatagggtagaaggcngacaaaacctaccgagccttggtggatagctggg

SEQ ID NO: 17759 - DNA, 263 bp, Homo sapiens
  misc_feature 41, 61, 65, 248: n = A,T,C or G
ttcaaacatagatgactgttttcctgttccagaattgaganctaaccgtgagtgcaggagngtgngctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttgggtggttattttgtacataatcgggaggntgcagaaatcttggg

SEQ ID NO: 17760 - DNA, 215 bp, Homo sapiens
  misc_feature 21, 57, 71: n = A,T,C or G
tttcatcagggaatgattttntcccattattaatataagtaccatttcccttttgtntgatttaaagattnctgtttctcccatgttttcattgtgcagtctgaactactattggcacagctatatttacataaacagttctaaacctagggatcaattattggtatttttttgtttaagaaaatatttttatggaatatcaatgggcttttttc

SEQ ID NO: 17761 - DNA, 318 bp, Homo sapiens
  misc_feature 25, 28, 214: n = A,T,C or G
ctgttcacaccacagccatcagcantgnaatgaaaaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgcccaagggcnacataacacctgcagttaaagggaatacccttccgcgaaggcgggctttttcgggagcatgcaatgttttattaggctcccaagcccagggccaaggaccccgg

SEQ ID NO: 17762 - DNA, 244 bp, Homo sapiens
  misc_feature 14, 24: n = A,T,C or G
tggccgtgggtttntacggacagncccagccaagctgcttcgacggtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggtcattgggggatgggcatccgatgctaaccatgggttgc

SEQ ID NO: 17763 - DNA, 279 bp, Homo sapiens
  misc_feature 11, 27, 49: n = A,T,C or G
aacaatatctntgtagttggatcaagngacttctgcccacctggcacanaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctgggcaaaatcttgttaatggtcattgcttaaaaaataaaataaaagctagatacctggaaacctaactgcaatg

SEQ ID NO: 17764 - DNA, 248 bp, Homo sapiens
  misc_feature 28, 49, 52: n = A,T,C or G
gggagcaagagtctcatgcctgtatttnccagcactttgggaggccggngcngagtggccgaggtcaggagatctagaccatcctggctaacacggtgaaaccctgtctctactaaaaatacaaaaaattagccaggcgtggtggctggtgcctgtagtcccagctactcgggaggctgaagcagcagaatagcatgaacctgagaggcggagcttgcaggtgagccaagacagcgccactgcactcc

SEQ ID NO: 17765 - DNA, 301 bp, Homo sapiens
  misc_feature 153, 177, 222: n = A,T,C or G
cagagatgaagtacttcctttttcaacatgcaattttctttctgaaactaatatgtaaaggaagatttgttacagaaaaagaatcgtggaggtaggaagcccaaaaggaagatgaagacacaaaaattagatgcagatctcctagtccctgcnagtgtcaaagtgttaaggagaagnaaccgaaaaaagaaagatgatcctgcagatgaaggaaagaagagnttttgaaggaactcaaaggctctgaaccccacatgaggaactagaaatcaagggtcggaagggacaagctttctaataa

SEQ ID NO: 17766 - DNA, 193 bp, Homo sapiens
gcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaaaaaaaaaaa

SEQ ID NO: 17767 - DNA, 263 bp, Homo sapiens
  misc_feature 175, 199: n = A,T,C or G
agttgatagctctaaaggtagatatgctgtatttgcctactttaacccttttcaacctgtttgttttttaaaaggcttcactaagggttgatatgtaccattgtatggggcaattttaagtcagctaaggcaataacctcatgcatgaacatttcccagactttcatgaagctgntgaggtcctaggcaattaatgcangcagttgcgataaataaaaacatctcacctaaagtctccttttctttcgtaacattagaatact

SEQ ID NO: 17768 - DNA, 315 bp, Homo sapiens
  misc_feature 24, 47, 56: n = A,T,C or G
ggggaggcattgaggcagccagcnttggggcttctgctgagggggcnggcggagtngaggaaaccgcagataagtttttttctctttgaaagatagagattaatacaactacttaaaaaatatagtcaataggttactaagatattgcttagcgttaagtttttaacgtaattttaatagcttaagattttaagagaaaatattgaagacttaagaagagtagcatgagggaaggaaaagataaaaggtttctaaaacatggacggagggttggagatgaaagcttcttcatgggagtaaaaaaaatgtattttt

SEQ ID NO: 17769 - DNA, 257 bp, Homo sapiens
tacacaattactgtgtgcttgacaagctgcgggactttgtggcctcgcccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagaggaaagaacccaagagaacttaaag

SEQ ID NO: 17770 - DNA, 241 bp, Homo sapiens
  misc_feature 15: n = A,T,C or G
cagcagtaccatgcnttagaaaatgttattttccttatttggaaaatggtataatcaaaattatggaagaaagtttgtacagggtaaatctatagacgttgcctgccatcctggctacgctcttccaaaagcgcagaccacagttacatgtatggagaatggctggtctcctactcccagatgcatccgtgtcagctttaccctctgaacttctgatcgaaggtcatccctctccagcttg

SEQ ID NO: 17771 - DNA, 265 bp, Homo sapiens
  misc_feature 20: n = A,T,C or G
aggcattgaggcagccagcntaggggcttctgctgagggggcaggcggagttgaggaaaccgcagataagtttttttctctttgaaagatagagattaatacaactacttaaaaaatatagtcaataggttactaagatattgcttagcgttaagtttttaacgtaattttaatagcttaagattttaagagaaaatattgaagacttaagaagagtagcatgagggaaggaaaagataaaaaggtttctaaaaacatgacggga

SEQ ID NO: 17772 - DNA, 293 bp, Homo sapiens
  misc_feature 23, 55, 222, 272: n = A,T,C or G
gggaggcattgaggcagccagcnttggggcttctgctgagggggcaggcggagtngaggaaactcgcagataagtttttttctctttgaaagatagagattaatacaactacttaaaaaatatagtcaataggttactaagatattgcttagcgttaagtttttaacgtaattttaatagcttaagattttaagagaaaatattgaagacttaagaagagtngcatgaggaaggaaaagataaaaggtttctaaaacatgacggaggtttgnagatgaagccttcttcatggg

SEQ ID NO: 17773 - DNA, 209 bp, Homo sapiens
cttctcccagaatatggaggcaccaaagtagttctagatgacaaggattatttcctatttagggatggtgacattcttggaaagtacgtagactgaaataagtcactattgaaatggcatcaacatgatgctgctcacttgaagttctgaaatctttcgtcatgtaaataatttccatatttctcttttataattaaactaaaaaaaaa

SEQ ID NO: 17774 - DNA, 210 bp, Homo sapiens
  misc_feature 13, 25, 35, 43, 159, 164: n = A,T,C or G
ctccagagccatntctgagactcgnactctgatgntttaatancagatcattacccaccatatgcctcccacgggccaagggaaaacagacaccagaacttgggttgagggcactaccagactgacatggccagtacagaggagaactagggaaggaantgatngttttgcaccttattgaaaagaaaattttaagtgcatacataatag

SEQ ID NO: 17775 - DNA, 216 bp, Homo sapiens
  misc_feature 175, 181: n = A,T,C or G
ttcaccgaagaccagaccgcttagttcaaggaggccttccagctgcctgaccgaacaggtgatggcaagatcctgtacagccagtgtggggatgtgatgagggccctgggccagaaccctaccaacgccgaggtgctcaaggtcctggggaaccccaagagtgatgaagatgaangtgganaggtgctggactttgagcacttttctgcccatgct

SEQ ID NO: 17776 - DNA, 182 bp, Homo sapiens
  misc_feature 98, 102: n = A,T,C or G
agaattccataatgaggggagagaattatctccaaaaatatgttatgaggctttacgtagcaatgtatatatattgcgaatatactaagcaatgtctngagnatattcatgaccaccacacggaggaagctgggccagataaaggagaaccaggagtgaataagctctaaaagaaaggatgt

SEQ ID NO: 17777 - DNA, 243 bp, Homo sapiens
  misc_feature 29: n = A,T,C or G
cccccgttaccagacgagctacctaagancagctaaaagacacacccgtctatgtagcaaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagggaaaaaacctccgc

SEQ ID NO: 17778 - DNA, 210 bp, Homo sapiens
cgtgacggagctgaccagacctttccagaagtgccggacgtcgggcagcgtctataccaccttgaagaagtatgacggccgaaccaaacccattccaaagaaaggtactgtggagggcttttgagcccgcagacaacaagtgtctgttaccgagctacccgatgggaagaagaagatcagcactgtggtgagctccaaggaagtgaataa

SEQ ID NO: 17779 - DNA, 342 bp, Homo sapiens
taagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaaggcggtccatcataatctatgatcttgtacagcacttatagaaataagctgttcttttgaagttgaaatacccagtaaaatgttgaagaaggatggaggatttc

SEQ ID NO: 17780 - DNA, 344 bp, Homo sapiens
ttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggggtgc

SEQ ID NO: 17781 - DNA, 433 bp, Homo sapiens
  misc_feature 233, 335: n = A,T,C or G
agttgcgaatttctaaagagatgttaattggcctccactgtagttagttgacgagtatgtggaagaatttgaagattagaaatatggtagatgaccttcaaatcaaaagtgagtgaatagtaggtatcgggggtatttggattctagttctgacggatactgactctgggatcttgagcaaatcaatttgtctttctcaatctcctttttcatctataaaatatcgatgatanggaataactctaccttatatggtttgtaaagatcacatcaactaacatgataatatatatggttatatatagagagcacgttgcctaactgcagattgcttncacttcagtccactgtgaatggtgcctcctggaggtgtgccaagtactgtgcccagaacacaatgggcaccctcagttaattggactctgatttaaaa

SEQ ID NO: 17782 - DNA, 560 bp, Homo sapiens
gataaactgaaagctgagcgtgaacgtggtatcaccattgatttctccttgtggaaatttgagaccagcaagtggtatgtgactatcattgatgccccaggacacagagactttatcaaaaacatgattacagggacatctcaggctgactgtgctgcctgattgttgctgctggtgttggtgaatttgaagctggtatctccaagaatgggcagacccgagagcatgcccttctggcttacacactgggtgtgaacaactaattggcggtggtaacaaaatggattccactgagccaccctacagccagaagagatatgaggaaatggtaaggaagcagcacttacattaagaaaattggctacaaccccgacacagtagcatttgtgccaattctggtggaatggggacaacatgctggagccaaagggctaacatgcctgggtcaagggagggaaggcacccgtaaggatggcaatgccagtggaccacgccgcttgaggcttggactggatcctaccccaactggccaaatgaaagccttgggcctgcctttccag

SEQ ID NO: 17783 - DNA, 529 bp, Homo sapiens
ggaaagaataggcaattatattttgctaggtcatttgattatatggaagaaaataaaattgggttggtacctcaccctacatagaagttaatttcaggaacattggaaatctgaagagccaaacttctagaaggaaatagaggagaataccttcatgacttctgggtagggaaatggttcataagtaatacaaataagcacaaactgtaatgtaaaggtacatattttacttcattaaaagtaaaacttgtaccctcatgccaaagaaaacccataaagaaatgaaaagataagccacagctgagaaaagtaggttgcaaggtatattattaacaagagattaaaatctattggtaatatcagcaaatcggcaaggaaataaaaataaccaggagatcctaacattcaaggtatggcagaggaaatcccaatagccaataaatatgaaagatattcaaatttatacactaatcagggaaatgtacattaaaactgccatgaggaaaaaaaaaaaaaaaaaaaaaaaaaa

SEQ ID NO: 17784 - DNA, 439 bp, Homo sapiens
gagctctgaaagatagcactttggaggatggatctagcattgaggaaggtataggagggagacaggttcatggccacaagaaaagataattgctgtagttgtagaggtgagtaagagcatatctggtgatcgattaagcatgaggattgtggaagaatgaaaaggctaaagaaaacttggggttctgcttgattaattgggcggtgccattcatcatgatgcatatagaggacagagaacatgcttcaggggtgggtgcaggaagcagggaaaagagaagggactttgggtttgcatgttaggtttgaggtgcctgagggacatccaggtaggagatggccagggggatttgaacatgtgaacatgaggactaggctaagaggtgccattggtggagagtgattgctcagtgatgttgaaaatacatggattgagaaaa

SEQ ID NO: 17785 - DNA, 408 bp, Homo sapiens
ctcggtcttagcgccatttttttggatacctctgcgccatgagagccaagaggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgctcaatggatctagaacttcatcgcctctgatcgcgatcacctctgagacccaccttgctcataaacaaaatgcccatgttggcctctgccctggacctgtgacattctggactatttctgggttatttgtggccgagtgtaacaaccatataataaatcacctcttccgtggtttagctgagg

SEQ ID NO: 17786 - DNA, 321 bp, Homo sapiens
  misc_feature 173: n = A,T,C or G
attttcgttggccagaatgtgaatgtattgactggagtgagagaagaaatgctgcggcatctgttgtcgcaggtatattgttttttacaggctggtggataatgattgatgcagctgtggtgtatcctaagccagaacagttgaaccatgcctttcacacatgtggtgtattnccacattggcttcttcatgataaatgctgtatccaatgctcaggtgagaaggtgatagctatgaaaagccggcttgtttaggaagaacaggtgctcgagttggcttttcattggttcatgttgatgttggtcacttattgcttccatg

SEQ ID NO: 17787 - DNA, 454 bp, Homo sapiens
  misc_feature 14, 30, 104, 122, 124, 138, 208, 211, 212, 245, 300, 346,369: n = A,T,C or G
tttatgcttaagangtaaaaatggcaggcnacctagataattttcgttggccagaatgtgaatgtattgactggagtgagagaagaaatgctgcggcatctgtngtcgcaggtatattgttntntacaggctggtggntaatgattgatgcagctgtggtgtatcctaagccagaacagttgaaccatgcctttcacacatgtggtgnatnntccacattggctttcttcatgataaatgctgantccaatgctcaggtgagaggtgatagctatgaaagcgctgttaggaagaacaggngctcgagtttggcttttcattggttcatgttgatgttcgggcactnatgcttcatgtggatcttttggngctatgtacccaaatactgatgttatccggactagctgggtttttcaaaagcacttatatttttagcctctgactacaaattgga

SEQ ID NO: 17788 - DNA, 153 bp, Homo sapiens
  misc_feature 101, 110: n = A,T,C or G
tactaagatattgcttagcgttaagtttttaacgtaattttaatagcttaagattttaaggagaaaatatgaagacttagaagagtagcatgaggaagganaagataaanggttctaaaacatgacgggggtgagatgaacttcttcatggag

SEQ ID NO: 17789 - DNA, 392 bp, Homo sapiens
taccatgactggatgttctaagattattattggcatcttgtgaagttcccctgctaatctatattatcctctgaatttttccctccaagactggttattaaaaataaagtttagggccaggcacagtggctcacacctgtaatcgcagcactttgggaggctgaggtgggttggatcacacggtcaggagatccgagaccgtcctggctgacatgggtgaaaccccatctctactaaaaatacaaaaaattagccaggcgtggtggttgggcgctgtagtcccagctacttgggaggctaaggcaggagaatgacgtgaaccccggagcggagttttcaagtgagcggagatccagctactgcactccagcctgggcgacaagagtgagact

SEQ ID NO: 17790 - DNA, 145 bp, Homo sapiens
  misc_feature 23, 64, 70: n = A,T,C or G
tgggcggcctgtagtcccagctncttgggaggctaagggcaggagaatgacggtgaaccccggnggcggngcttttcaggtgaagcggagatccagctactgcactccagcctgggcggacagagtggggactccatctcagaga

SEQ ID NO: 17791 - DNA, 435 bp, Homo sapiens
ccgtggccttagctgtgctcgccctactctctctttctggccttggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttggactacactggaattcacccccactgaaaaaagatgaagtatgcctgccgggtgaccatgtgactttgcacagcccaagataagttaaagtggggatcgagacatgtaagcagcatcatggaggtttgaagatgccggatttgggattggatgaattccaaaatctgcttgcttggctttttaatattg

SEQ ID NO: 17792 - DNA, 394 bp, Homo sapiens
  misc_feature 27, 56, 61, 119, 142, 156, 165, 228, 247, 293: n = A,T,C or G
aggttatccagcgtactccaaagattnaggtttactcacgtcatccagcagagaanggaanagtcaaaatttcctgaattgctatgtgtgtggggattcatccatccgaaaattgaagntgacttactgaagaatggtgggngaattgaaaaagtnggagcattnaagacttgtctttcaagcaagggctgggctttctatctcttgtactacactgaattacccccnctggaaaaagatgaagtantgctgcggtgtgaaccaatgtgactttgtcacaagcccaagatagntaaggggggatcgagacatggaagcagcatcatggaggtttggaagatgccgcatttggattggatgaattccaaatctgctgcttgctttttaatatgga

SEQ ID NO: 17793 - DNA, 153 bp, Homo sapiens
  misc_feature 51: n = A,T,C or G
tggatgaaacacttgaagaaaggcccttacaggtcaccttgaggagggtgntttagctctgctaaaaactccagcgcaatttggatgctgatgaacttcggctgcatgaagggccttggaactgatgaagatactcttaattgggatttggca

SEQ ID NO: 17794 - DNA, 463 bp, Homo sapiens
  misc_feature 31: n = A,T,C or G
aaagacactttcagcaaagatggcaatgtgnatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgcaacagatcaaagcagcatatcttcaggaaacaggaaagcccctggatgaaacactgaagaaagcccttacaggtcaccttgaggaggttgttttagctctgctaaaaactccagcgcaatttgatgctgatgaacttcgtgctgccatgaagggcttggaactgatgaagatctctaattgagattttggcatcaagaactaacaaagaaat

SEQ ID NO: 17795 - DNA, 415 bp, Homo sapiens
  misc_feature 43, 355, 407: n = A,T,C or G
tagaacgtgagctccatattcagtatagctcagcgaattacgnatgtattaaaagtgggcatctaagttcccagaatttttttctttttgaaaaattcttgactcaaataattatcttaattaattactgcaaagagtcaaagatttttttaaaagacatttattattcgaatggtgaaaatattagatgaaaacaagttatccagacatattgacatttgtttgctaataaagatagaaaaaccataaaccaaaggtgtatactttaaaaatatataatagagttaagaaaaactccaaattaattatcagggtttttgaagtggtctcagggcaacactctatctgattgggngtctttgctcattcttcatcaggtactttatatctcaagcaaatctattagntgtccaag

SEQ ID NO: 17796 - DNA, 195 bp, Homo sapiens
  misc_feature 168: n = A,T,C or G
tgcccaacatcagaaaacctgcggctatgattactatgccttttctaaagatcaatactataacattgatgtgcctagtagaacagcaagagcaattactactcgtctgggcagaccttatccaaagtctgggtacaactgtccttagactgatgagcaaaggaggancaactaatgaagaaatgaataataaat

SEQ ID NO: 17797 - DNA, 332 bp, Homo sapiens
  misc_feature 158, 171, 220, 256: n = A,T,C or G
gaacagaccatatgtagaccacaaaaccagtcttaacaaagtaaaagaaaaaaaatggctgggctctgtggattacacctgtaatcccagcactttgggaggccgaggcaggtggatcacctgaggccaggagttcaagaccagcctggcaacatggnaaaactctgtctntactaaaaacacaaaaattatctgggtgtggtggtgcacacctgtgatnccagctgctcgggaggctgaggcacaaggatcgctngaacctgggggaagttgcagtgagctgagatcatgccactgtactccagcctgggcagtagggtaagactgtcgcc

SEQ ID NO: 17798 - DNA, 446 bp, Homo sapiens
  misc_feature 23, 87, 103, 173, 413: n = A,T,C or G
cacgcacggcatgctcatgctgnctcacatcctccatcccatgcctcccctgtctccagcattccctctggaatacatcagcactgntgcctttgaggctggnctgcttgaatgcacacctgagctccggattcacagagtctcactctatcgccaggctggagtggtgcagnggcaagatctcggctcactacagtctccacctccagggttcaagccattctcttgcctcagcctcccaagtagctgggactacagttacacaccaccacatccagctaatttttgtatttttagtagagatggggtttcaccatgttgcccaggatggtctcgatctcctgacctcatgatctgcccaccttgcctcccaaagtgctgggattacaggcgtgagccaccgacccagctgntaaaaccatcttgaatgaccttcaaaaaaaaaa

SEQ ID NO: 17799 - DNA, 130 bp, Homo sapiens
acctgtaatcccagtactagggaggctgaggcaggagaatcacctgaacctgggaggtggaggttgcagtgagctgagatcacgccactacactccagcccgggagacaagagcaaggactccgtcaaaa

SEQ ID NO: 17800 - DNA, 365 bp, Homo sapiens
  misc_feature 77, 152, 173: n = A,T,C or G
cttgagattccagctcccttccaccaagcccagtcttgctacgtggcacagggcaaacctgactccctttgggcctnagtttcccctccccttcatgaaatgaaaagaatactactttttcttgttggtctagcattgctggcacaaagtgnagcattattgttgtattgggngatgtgtgcaaaactgcagaagctcactgctataagaggaaataagagagaaagtggaggagagggacaaaaggagtaattatttggtatagatccacccatcccaacctttctcttctcagtccctgctcctcatgtttctggtttggtgagtcctttgtgccaccacccataatgctttgcattgctgca

SEQ ID NO: 17801 - DNA, 309 bp, Homo sapiens
  misc_feature 20: n = A,T,C or G
gaagggaatgtaagatttgntttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaaca

SEQ ID NO: 17802 - DNA, 411 bp, Homo sapiens
  misc_feature 226, 329: n = A,T,C or G
ggactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagnctttgcacttacacacactcttcctgtctgccttcacctatgccgggataagcagagatctcatcaattaagctcttctctgcaaggcttccactgattctgnctgcttccatatcaagcctggatgcagctgctggtggttagagcagagatgaagaaagggtctgcataagtggcttcctgaa

SEQ ID NO: 17803 - DNA, 278 bp, Homo sapiens
  misc_feature 142: n = A,T,C or G
aggttctcctctgtcattcggcagccgtctcagtccatttgcggaggaacattggtgttacagcagtggcatttaataaggaacttgatcctatacagaaactctttgtggacaagattagagaatacaaatctaagcgacngacatctggaggacctgttgatgctagttcagagtatcagcaagagctggagagggagctttttaagctcaagcaaatgtttggtaatgcagacatgaatacatttcccaccttcaaatttgaagatcccaaattt

SEQ ID NO: 17804 - DNA, 388 bp, Homo sapiens
  misc_feature 32, 35, 62, 70, 95, 97, 175, 222, 227, 308: n = A,T,C or G
gaataggaagaagggattcagaaatatgatgnagnagaacatgccctgcaggaagaaaatgntttctctnctgtgtatgttaagaggaaatcagntnaaaatgcctgctaatcaaatgtcgactcagctaaccatatgtccaggttgctgcagagtttctttcaaatctgagtgntgcctgctgaactcggaggggagtttggagaaattttagacagcagntctgngttctttttttgccggagccaataagataataagcagaattagccaatcctaaaaccttctaaagacgatttttgagcatnccactgggattatttaatttttctttttgacggggggttttaggttaagaaggctggattccacaagggttaagcagtga

SEQ ID NO: 17805 - DNA, 140 bp, Homo sapiens
tgaagacaataagtggtggtgtatcttgtttctaataagataaacttttttgtctttgctttatcttattagggagttgtatgtcagtgtataaaacatactgtgtggtataacaggcttaataaattctttaaaaggca

SEQ ID NO: 17806 - DNA, 257 bp, Homo sapiens
agggaaacactcgagaggtttattatttttaaaaaacttttcttgaactcctggccggcatggtgaaaccccgtctctactaaaaataccaaaattggccaggcgtgatggtgggtgcctgtggtctcagctacttgggaggctgaagcaggagagctgcctgaacccgggaggcggaggttgcagtgagtcgagatcgtgctactactgcctgggtggcaagggtgagactccatctcaaaaaagaaacaaaaaaa

SEQ ID NO: 17807 - DNA, 232 bp, Homo sapiens
cgacctgcaggggagtctcttctctagattccatcaaatttatgatgtctgacattccgaggtgggagtaggtgtggatcttggtcagtaaatcaaggggtggtctggggttttcagagatacactcttagggtctccagccatgcacagagcttgctcagactggagaaggagaggtgagagttcagagtcatattttggctagatgcagctgccttagtttaatgtaaaa

SEQ ID NO: 17808 - DNA, 266 bp, Homo sapiens
  misc_feature 25, 29, 40, 47: n = A,T,C or G
atataattttttccaagccaagganttcnttggccatccnggaaatntcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgctctggaaaaaaaaaaaa

SEQ ID NO: 17809 - DNA, 356 bp, Homo sapiens
  misc_feature 64, 252, 285: n = A,T,C or G
ttcaacagctaaatataagaactggcctgaatctgtgtattttttcaagagaggtggcagcatncagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgcagactggcttatcaagacaaaggngccttcataatgaaggtaaagtgagtatactgnggagaggacttccaaatgtgggtacctcagctatatcactgccacatcaagaaaacctgacggctatgatt

SEQ ID NO: 17810 - DNA, 429 bp, Homo sapiens
  misc_feature 269, 289, 293, 337, 352, 355, 382: n = A,T,C or G
gaatttagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgctttgcgttaaaaaatcattgcaaaagtattctgaactgcaagctgcccagtcaagatgggctgntggccacttaaaatcactgnaatnaattagtttggattaagagcacaaagcttagctaatcaaccatnattttcattttggtngtnctaaagaggattgaaaatcagtttagnttaaatgtctttctgtaggcctttcttcttacaatgaagagatgatc

SEQ ID NO: 17811 - DNA, 370 bp, Homo sapiens
  misc_feature 174, 300, 301, 343: n = A,T,C or G
aacaccgactacggcggactaatcttcaactcctacatacttcccccattattcctagaaccaggcgacctgcgactccttgacgttgacaatcgagtagtactcccgattgaagcccccattcgtataataattacatcacaagacgtctgcactcatgagctgtccccacantaggcttaaaaacagatgcaattcccggacgtctaaaccaaaccactttcaccgctacacgaccgggggtatactacggtcaatgctctgaaatctgtggagcaaaccacagttcatgcccatcgnnctagaattaattcccctaaaaatctttgaaataggggcccgnatttaccctataacaccccctctaccc

SEQ ID NO: 17812 - DNA, 243 bp, Homo sapiens
  misc_feature 28, 34, 59, 127, 144, 212, 215: n = A,T,C or G
tgaaattttccatttgtatggatctagncacttncagatttcaatttgaggttaagtanataaagcacatcccaattttatatgctgccttgagaaaattacaggatgcacggcaatttgtaggaanttcaaatgggatcattnaaacatttgaaaaattattttaaaaaccatctagtttgcttttggattttagacattaaagcctatgntgncttgtaacagggggggaatgtataacca

SEQ ID NO: 17813 - DNA, 367 bp, Homo sapiens
  misc_feature 95, 109, 166, 167, 210, 243, 258, 283: n = A,T,C or G
acccacatgacttattatgcataaagccaaatttccagtttaagtaattgcctacaataaaaagaaattttgcctgccattttcagaatcatctnttgaagctttctgntgatgttaactgagctactagagatattcttatttcactaaatgtaaaatttggagnnaatatatatgtcaatatttagtaaagcttttcttttttaattnccaggaaaaaataaaaagagtatgagcttctgnaattcattgagcagntagcccatttgagataaagtcaaangccaaacactagctctgtattaatccccatcattactggtaaagcctcatttgaatgtgggaattcaatacaggctatgtaaaa

SEQ ID NO: 17814 - DNA, 273 bp, Homo sapiens
  misc_feature 19, 44: n = A,T,C or G
tcgcaagattttaaacctngggggtgctggggccgccacaaggngacatgatctatgaccccagctggcaccatccgccttcactgataccctattattccaagacggactttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccaa

SEQ ID NO: 17815 - DNA, 128 bp, Homo sapiens
  misc_feature 14, 35, 36, 53, 55: n = A,T,C or G
atgaacatgaaaangtagcatttaaggcaggaaannactagagttattatggngnatcaatcaaaagctgtttctttgaaaatagaaaacttttggcaaatataatgaagaaagaggaaaaaaaaaaa

SEQ ID NO: 17816 - DNA, 308 bp, Homo sapiens
  misc_feature 17, 28, 229, 270: n = A,T,C or G
tatgaatacattaaagntgtactaacangaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgnaattgaacttgaacagacttttaaagcttaaaaattatganttaaatcttactctgagactctataaaaagaaaaaaaa

SEQ ID NO: 17817 - DNA, 469 bp, Homo sapiens
  misc_feature 7, 24, 160: n = A,T,C or G
gagaganaggactacaggggcccngaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaagaccttgaaatccatgacgcagggagaattgcgtcatttaaagcctagttaacgcatttactaaacgcagacgaaaatggaaagattaattgggagtggaaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacccgaaaagtagggaagcagaagaaaaaagacaagctaggaaacaaaaagctaaggcaa

SEQ ID NO: 17818 - DNA, 252 bp, Homo sapiens
agcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatgccatctgtcctggaaactgtagaattgaataaatcactgaaaatagaa

SEQ ID NO: 17819 - DNA, 198 bp, Homo sapiens
  misc_feature 36, 53, 59, 105: n = A,T,C or G
atgtgctatagagaataaaggcagttttaaaacatnatgtaaacgaatacagnattttnaaccagcctgcttaagaattaggtatttataactgatgaccttagntgcattgaaaagaaattgtgttttttaaatgtaaagtatttttatctgctgctttcatgtcaatttataaaatgactctaaaaaaaaaaaaaa

SEQ ID NO: 17820 - DNA, 354 bp, Homo sapiens
  misc_feature 12, 50, 116, 117, 123, 143, 146, 154, 163: n = A,T,C or G
ataggccatatnaccacaaatcacacaacaaaaaggagaagagatatttngggttcaaaaaaagtaaaaagataatatagctgcatttctttagttattttgaaccccaaatattnnctcatntttttggtgttgccattganggnggagacanggacttgtntatagaggcaggccagctgctggctcagtgatctacattctgaagttgcttgaaaatggcttcatgattaaattcagcctaaacggtttgccgggaacactgcagagacaatgctgggagtttccaaccttagcccatctgcggcagagaaggctagtttgccatcagcattatcatgatatcaggactgg

SEQ ID NO: 17821 - DNA, 179 bp, Homo sapiens
  misc_feature 13, 27: n = A,T,C or G
tactggagaggtngaggcaggagcacngcttgagctcacactgctgcacaccagcctgggtgacagagtgagactctgtcgcaaaaaaacaaaaaaaaagaagaagaaaggaaaaaagaaacgaaagaaagggagaaagagagggagagagcgagagagacagaccaaaggaaaaaaaa

SEQ ID NO: 17822 - DNA, 134 bp, Homo sapiens
  misc_feature 10, 48, 53, 54: n = A,T,C or G
gcggccaganaagtttttgtatttttagtagagacggggtttcactgnggacnngatctcctgacctcgtgatcctcccgcctctgcctcccaaagtgctgggattacaggcgtgagccaccgcgcccaggggc

SEQ ID NO: 17823 - DNA, 327 bp, Homo sapiens
  misc_feature 276, 288: n = A,T,C or G
aatagacaaacagaccaggggaacagaatagaaaacccagaaataaatctacatatttatagccaactgatctttgacaaagctgacaagaacatgcattgggaaaaggacaccctctactataaacagtgctgggataaatgaatgttcatatgcagcagaataaaactggacccgtatctctaaccatataaaaaatcaactcaagatgaattaaaaacttaaatgtaatacccacaactataaaaataataggggaaaacagcaaaaactctnttggacattggnctaggcaaaaaaatttatgagtaagacctcaaggctggg

SEQ ID NO: 17824 - DNA, 359 bp, Homo sapiens
  misc_feature 247, 297: n = A,T,C or G
acggaaaggtagaatttgctagggctgggatagggagggatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtggccttttaatttgtaaacactgaaatgattgttggctgnggaaaacatttacctatttaccttggaaggtttaaaagacagccactttntagcatgtgtgttgtgccagcctgtggcgtcttaactaataaatgtgatttttctccccgat

SEQ ID NO: 17825 - DNA, 305 bp, Homo sapiens
  misc_feature 14, 25: n = A,T,C or G
agatttttgaaatngagggatcagnaaaactcggaatgcacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagcctcagtgatcacacacgaaattctgccgaaggcacagaaaattt

SEQ ID NO: 17826 - DNA, 120 bp, Homo sapiens
  misc_feature 19, 47, 49, 56: n = A,T,C or G
tagatggataagtactttnttatttggaaagctcatttttagtaggntntgaagtntcatgtcctttgaagagaaaatagggggaggaaggaagaaaaacaacaacaaacgataaaaaaa

SEQ ID NO: 17827 - DNA, 217 bp, Homo sapiens
  misc_feature 14: n = A,T,C or G
gagtcagaggcgcngaaccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaaaaaaaaaaaa

SEQ ID NO: 17828 - DNA, 172 bp, Homo sapiens
  misc_feature 12, 53, 93, 99, 144: n = A,T,C or G
cacagacccgcnaaatgcccttgtaaatcaaacgcgggagtccaaagaggccngctgtttggcactaggaaaaaaccttgtagagagagtaangggggntaacacccatagtaggctaaaagcagcaccaattaagaaagcggncaagctcaacacccactacctaaaaaaa

SEQ ID NO: 17829 - DNA, 346 bp, Homo sapiens
attgcgcagactgatgaaagagaagagacagggactacctgtggtgatgccagtgtttgaccggaatacctgtagcatccccaagtctcagatctctttcattgactacttcataacagacatgtttgatgcttgggatgcctttgcacatcttgccagccctgatgcaacatttggcttgacaactacaaacactggaagacactagatgacctaaagtgcaaaagtttgaggcttcatctgacagctaaagccaagccacagagggggcctcttgaccgacaaaggacactgtgaatcacagtagcgtaaacaagaggccttcctttctaatgacaatgacagg

SEQ ID NO: 17830 - DNA, 149 bp, Homo sapiens
caaagtccaaactccatctcaaaagcaaaacaaaacaaacaaaacaaaggaaatactcattggagcagttcggattttggctttgaagatttgggatgctcaactgttaagcaaaatgcaagtatttgaaaatcaaaaaaaaaaaaaaa

SEQ ID NO: 17831 - DNA, 368 bp, Homo sapiens
gagaaacagtataagaaagctcatttgggcacagccctaaaggccaacccttttggaggtgcttctcatgcaaaaggaatcgtgctggaaaaagtaggagttgaaaccaaacagccaaattctgccattaggaagtgtgtaagggtccagctgatcaagaatggcaagaaaatcacagcctttgtacccaatgacggttgcttgaactttattgaggaaaacgatgaagtctggttgctggatttggcgcaaaggcatgctgttggtgatattcctggagccgctttaaggttgcaaagtagccaatgtttctcttttggccctatacaaaggcaagaaggaaagaccaagatcataaatattaatgg

SEQ ID NO: 17832 - DNA, 167 bp, Homo sapiens
  misc_feature 17, 43: n = A,T,C or G
gcagggggagctctttnctggaccaagggaggagccgctcatncacccaacaaaactgtgtcttatctgccaggaaagaccagcctcactcctgggaactgtctggcaggtaggctgggccccccagtgctgttagaataaaaagcctcgtgccggaaaaaaaaaaa

SEQ ID NO: 17833 - DNA, 431 bp, Homo sapiens
  misc_feature 206, 221, 268, 307, 385: n = A,T,C or G
ctgtctgtttctggcctgggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggnctttctatctcttgnactacactgaattcacccccactgaaaaagatgagtatgcctgccgngtgaaccatgtgactttgcacagcccaagatagttaagngggatcgagacatgtaagcagcatcatggaggttgaagatccgcatttggattggatgaatccaaattctgcttgctngcttttaatattgatatgcttatacacttacactttatgcacaaaa

SEQ ID NO: 17834 - DNA, 329 bp, Homo sapiens
  misc_feature 99, 122, 164, 191: n = A,T,C or G
gatatatgctgcttaaacacaaatacgttttaaaatatattttaggcagtagggttttgggttttttttttgcaagttcttttggggagtaaatttagngataaatgatttttttttctttngagacagtttgctctgtcgcccaggatggagtgcagtgcagnggcgcgatcctgcaacctccgcctctngagttcaagcgattctcctgcctcagcctcccgagtagctgggattacagacgcgcgccaccccacccagatgatctttttaaatgcaaaatgccatcgcgcagaaaatcaaagaatcagcttaagttccagaaaaaa

SEQ ID NO: 17835 - DNA, 398 bp, Homo sapiens
agatctagatcacaacaagacactgctttatatctgtttatttaataaaaagtgacactaaaaatgttggagagtatgtggatcagcaggatcccttatccactgcttatggggatatataaataatggtaccacttagaaaaatagttaagcattaccttccgaagttcagcagttacataccctatagcttggcaattccatacccatgtttaacctacagaaacttggatatgtttagcactcctggttagacttgacaagaatgctcatagtagcaaatgttcacattagtaaatcttgaaaagaagccagatatgtgtaaggagtaagtgaattaactgatatattcatacactgggacagtaaactgtcatcaggaaagggatgaagtatag

SEQ ID NO: 17836 - DNA, 190 bp, Homo sapiens
catcttggtcaacatggtgaaaccccgtctctattaaaaatacaaaaattagctgggcgtgctggtggacgcctgtaatcccagctactcgggaggctgaggaaggagaatggcttgaacccgggaagtggaggttgcattgagccaagatcgcactactgcactccagcctggcagcagagtcttaaaa

SEQ ID NO: 17837 - DNA, 181 bp, Homo sapiens
  misc_feature 16, 25, 62: n = A,T,C or G
agcacttatggtaganattaggganattagaaaatacttggagacaaatgaatatacagcanacccaaacttatggaatgcagtgaaaaaagtgctcagaaggaaaaattatagctgtaagtgacagagtgagaccctgtctcaaaacaaacaaacaaacaaacaaccccccccaaaaaaa

SEQ ID NO: 17838 - DNA, 426 bp, Homo sapiens
  misc_feature 72, 205, 329, 376: n = A,T,C or G
gatagagattaatacaactacttaaaaaatatagcaataggttactaagatattgcttagcgttaagttttnaacgtaattttaatagcttaagattttaagagaaaatatgaagacttagaagagtagcatgaggaaggaaaagataaaaggttctaaaacatgacggaggtgagatgaagcttcttcatggagtaaaaaatgnatttaaaaagaaaattgagagaaaggctacagagccccgaattaataccaatagaaggcaatgcttttagattaaaatgaaggtgacttaaacagcttaaaggttaagtttaaaagtggagggngattaaaataatttgaggcgatcttttaaaaagagattaaccgaggngattaaaagaccttgaaatccatgacgcagggagaatgcgcatttaagct

SEQ ID NO: 17839 - DNA, 396 bp, Homo sapiens
  misc_feature 14: n = A,T,C or G
acagagcaaaaganactgctcaatgacaatgaagaaaaataagtcttgtctctatggcttggtacatttatgtgtgtctccagctgatttatcatggatgaatggatggatgttaagtgttatgtggaagtcagcccattgcagacaagtttgttcatctagggccaggcagggtgctgatgcctgtaatctcagcactttgggaggctgagaaggcagatcacaaggtcaggagtcgagaccagcctgccaacatagtgaaaacccatctctactgaaaatacaaaaattagccgttgcgtggtgcacatggctgtagtcccagctactcgggaggcttgaggcaggagaatcacttgaacctgggaggcagaggttgtggcaagccgagatcgc

SEQ ID NO: 17840 - DNA, 333 bp, Homo sapiens
  misc_feature 26, 40, 95, 287, 293: n = A,T,C or G
gctttttatcaccagagccagtggcnagaatagctgaggncccacaagcaaacttctacattggcaatttcctttctagcatcatttttcacagncataagtcatgttataagaattttctaattgctaatgatggtccttgtaaggaaatatatgataaatgttactataataataccaagacctaactggtacttgtggctgccttctatgaagtcattcttccccatttaaacacataagagtctgccttacatcagaatgagacgtaactatcccctgttagnggtggntttaaatcttgaatctaacagctaatgaaaaaaaaaaaaa

SEQ ID NO: 17841 - DNA, 358 bp, Homo sapiens
  misc_feature 155, 247, 256, 305: n = A,T,C or G
tggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggncatgggccaacctaggactctggagtatgcagacttggcattcgccattgtggctgcgggtcgaccccaggcatactgaaaggcatactcgngctggctgnctgcggcctaagccttcccaggatctttcaggacacttgacagacttgnggtttctggtctgagctgcctccacaggtcccttcagcaagcctaactgacct

SEQ ID NO: 17842 - DNA, 275 bp, Homo sapiens
  misc_feature 19, 156, 193, 196, 198, 237, 255: n = A,T,C or G
gagaccacggtgggcaggncatgaggacagcaatggttgtatcaactatgaagcgtttgtgaggcatatcctgtcggggtgacgggcccatggggcaggagctggtccgatggtgcttgaatggctgaggaccttcccagtctccccagagtccgngcctttccctgtgtgaattttgtatctagcctaaagnttncntagctttcttgtctaagcactttccaatctggctctctngatgatgtttgccgcagnattcaccaaataactgctct

SEQ ID NO: 17843 - DNA, 114 bp, Homo sapiens
  misc_feature 37: n = A,T,C or G
gtgaaaaatagcaagattagagaatgagttgtatagntttttctatcacatttcatctaaaatgatttgaaggacttttgaagatttttaccaacatccttaaatcaactccag

SEQ ID NO: 17844 - DNA, 336 bp, Homo sapiens
  misc_feature 34: n = A,T,C or G
agggcactgtggccagggttcacattggccaagntatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggcctctggacaagtggcggccctgcactcatgaggcttcaatgtgctgccccctcttaatactcaccaataaattctacttcctgtcacctcc

SEQ ID NO: 17845 - DNA, 353 bp, Homo sapiens
gtcagaattgtatttttatggcattaaataaattaactttatttctgtccatatcaacatccaaagtttattaggaatttatttaaagaataataaaagcaataggacctaacatttaatgagtgcttactgtgtcaaataccattctaaacagtttacatgtattcttatttatttttaagtacaatataaatcataggtattgagcatgcaaataaataaatagtaaggatattaggcatagatccacagatacactggtagagtgattttcgaaggcatttcggccgtcagatcttcaccaaacccattaattttatgcttgggaatttatttgaaaaaataactcagaa

SEQ ID NO: 17846 - DNA, 476 bp, Homo sapiens
  misc_feature 22, 31, 41, 324: n = A,T,C or G
agtttagagtcgactggggcgnggcggcagntatgattacngacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaaggcttgctttttgccgttgccaagataaatagaactatctgcattatctatgcagcatggggnttttattatttttacctaaagacgctctttttggtaataacaaacgtgttttttaaaaaagcctggtttttctcaatacgcctttaaaggttttaaattgttcatatctggcaagttgagatttttaagaactcattttaatttggaataaa

SEQ ID NO: 17847 - DNA, 265 bp, Homo sapiens
  misc_feature 40, 69, 105, 114, 120, 138, 155, 161, 175, 176, 193, 199: n = A,T,C or G
ttggattgcgggaagatcaggtaaggttggtctgttgtanggcatgactgagcgagaggcgatcggcgngctacgtggggcacaagggcaagttcggccacgagntcctggagnttgagnttcgaccggacgggaagntaagatatgccaacaanagcaantacaagaatgatgnnatgatcagaaaagaggnttatgnacataaaagcgtgatggaggaactgaagagaataattgacgacagggaaattaccaaagaggatga

SEQ ID NO: 17848 - DNA, 442 bp, Homo sapiens
  misc_feature 232, 262, 323, 353, 359, 376, 411: n = A,T,C or G
tgaaaaagattgctagctgcctacctcgcctgttcccctttctttaccaacacaaccctgattttgtgcccatttagaaatagctgtctcatctgatgtcctttagaggtctcagtggtggccaatgagatgtgagcttaggatttctgagaaagttttactccttgaatatggggtccggtctttcttcccccacccttgaagtggacataatgtttagagctgcggcagntgtcttgcaagaggtgaaaatgaggctagnggtaaagacggcagagcaggaggcaaaaggaggctaggttcttgatgacatccttgactgngtacaacaagccatggttgcttactcctgnacttgnaggcagaatgacttggnctgtctagctaggccttaggtagcctggcaagggnaatcctgtggaaatagctatatctacaagat

SEQ ID NO: 17849 - DNA, 267 bp, Homo sapiens
tgatgcgaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactgtaaagcctcatttgaatgtgtgaattcaatacaggctatgtaaaatttttacta

SEQ ID NO: 17850 - DNA, 448 bp, Homo sapiens
  misc_feature 220, 225, 319: n = A,T,C or G
gtgggaaggccgatggctccactcttttaacctgaggtttgtagtcctcactgggacaagcttactcctggctgagtccacatgtcctcactggagacagagaacctccaaactagtttcacactagtagcttactttgtagctgcacacatggcataagactcaaaaggaactggaggacaataaaacccagggcagactgaaaacattctggatttgnaaagncttgaatttaggatatgcaagtaactcctacagctcaatgataataaaataaacagtgaaattaaaatatgggtaaaatatttgaatagctggnttttcaaatgatatatagaaatggctaataagcacataaaaagatacctatcattaattattagagaaatggacatataagtcacaatgcgctattactacacacctactcgaatggatataatcaaag

SEQ ID NO: 17851 - DNA, 223 bp, Homo sapiens
  misc_feature 108: n = A,T,C or G
cagagaagtgcaaacttcccaaacctgactgcattcaaattgtctgtaaaagatggtccaaaaacatcatttctggtctatacttgtggtgaagccagtgttgcaggnctgatgtggggacttggaagtgaggtttttaacaagctccatgagtgtttctgacacactgtaagtttgggattcattgttaaagtggcaacacagccatgaaaataatgtgcgg

SEQ ID NO: 17852 - DNA, 403 bp, Homo sapiens
  misc_feature 137, 151, 155, 157, 173, 266, 318, 359, 368: n = A,T,C or G
actccaaagattcaggtttactcacgtcatccagcagagaatggaaagtcaaatttcctgaattgctatgtgactgggtttcatccatccgacattgaagttgacttactgaagaatggagagagaattgaaaaagnggagcattcagacntgtntntcagcaaggactggcnttctatctcttggactacactgaattcaccccactgaaaaagatgagtatcctgccgggtgaaccatgtgactttgcacaagcccaagatagntaagggggatcgagacatgtaagcagcatcatggagggttgaaagatgccgnatttggattggatgaattccaaatctgcttgcttgcttttnaatattganatgcttatacacttacactttatgcacaaaaagga

SEQ ID NO: 17853 - DNA, 155 bp, Homo sapiens
gccctaatagtagaagaaccctccataaacctggagtgactatatggatgccccccaccctaccacacattcgaagaacccgtatacataaaatctagacaaaaaaggaaggaatcgaaccccccaaagctggtttcaagccaaaaaaaaaaaaa

SEQ ID NO: 17854 - DNA, 362 bp, Homo sapiens
  misc_feature 119, 123, 144, 230, 275, 303, 312: n = A,T,C or G
gtaaaataactgcactgattctcccacctagcccagttcagaaatcatataacacatccatgaggtacatagcagaccatctacatttacatatttttctggccccatccaagctggtngggnccaaaatttataatctaccgngactttgaagagagaatagaatcagattctaattgggcaattcacagaatttcaaatttgcacaactagaaatttagatttttaanggggggaactatcatggccactaaagaagctaaaatttaaagagnaacattctagctatgtaatgctaagatngagccaaanaggtttatctaagtttatttcattagctgaaaattatggcctttgggggg

SEQ ID NO: 17855 - DNA, 310 bp, Homo sapiens
atcaacgggctgtgtattaaatggttttattttcagttttgcagcacagaacactgttgaaatatccatatcaacttgatttttttaacctaattcagttgtcctttgcatctcttaaatgttgggggtgggggtcagagccagttatccggcttctgttttgtcgattgcttagatttgttcctgttgcaaaactgttacccccaaaattggtgtgacacatgctcatgcataaaatggtaaaatgagtaccatccttgtatttgaatttgtttcaacatcgccaaaggtgctatgggaaattaacaaa

SEQ ID NO: 17856 - DNA, 112 bp, Homo sapiens
  misc_feature 95: n = A,T,C or G
agacaggtgtgctgatgtaactctggagggccaggtgtaccccggcaaaggaggaggaagcaaagagaaaaataaaacaaagcaagacaaggacncctttaaaaaaaaaaaa

SEQ ID NO: 17857 - DNA, 133 bp, Homo sapiens
gacatcatactaaatggtgagagactgaaagctttccctctaaaatcaggaacaagacaagggtatctgctcttcctacttctattcaacattgtcctggaggttctagaaattaggcaaaaaaaaaaaaaaa

SEQ ID NO: 17858 - DNA, 318 bp, Homo sapiens
  misc_feature 275, 292: n = A,T,C or G
agcgtgggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttatttttgtttagatgtaagagcatgctcatatgtaggacttacataaattgtacattatttttctatgaanaccttttgttgttatgnggtcaatatatcttccttaaaaaaaa

SEQ ID NO: 17859 - DNA, 433 bp, Homo sapiens
  misc_feature 22, 115: n = A,T,C or G
gtttaagtaacatcgctcaagntgataatctcttgataagctctgttgttgacattttgcagtgatacaacagctccactcatagatttaaacttttatttttacttatcttggncataagttggcattctctcacatcccacatgatatagagggctacgttttggaattttccttttcttaattgcccagagttatcaagacagattataaaaatggcttttaatggcttaaaccatttctaaacctctatcttagcagacaatgcaggatctaattcttttgataaggtctagctctaaaagtgataggggggactgtatgtttctgatactggggcttatggtattaaaccttttttaaaaaaggtcactctaaaagctgacctacatccttaggttcaggctacttgactctatcaggagctttttaa

SEQ ID NO: 17860 - DNA, 102 bp, Homo sapiens
  misc_feature 7, 31: n = A,T,C or G
ggttgtntaaatgaaggtatgaatgctcagncagaggcaagatcagggagatggtacaaggcctgtttgttacatggatgagtccgggtgcctggttgtgtg

SEQ ID NO: 17861 - DNA, 189 bp, Homo sapiens
  misc_feature 101, 103, 110: n = A,T,C or G
gagtagaggctgctgtgaaagaggctggctacacaatcgaatggtttgaggggatctcgcaaagttattcttccaccatggccaacaacgaaggacttttntncctggtnggcgaggaagctgagcagacccctgtgatgcctgggacctcaattaaagcaattcctttgacctgcaaaaaaaaaaaaa

SEQ ID NO: 17862 - DNA, 357 bp, Homo sapiens
agctaggagtagaaggaaatatcttcaacccaataaaggatatctatgaaaactctaaagcaaaacctcacacttaattttgaaacattagctgcattcctgcagaatcaagaacaagaaaaggatgcttactctttctgcttcctttttgtactagagattttagccaatgtaataagaaaagaaaatgagaagtcagacaaaaggattaaaaaggaaagagaatggactgatattatttgcataaaacataattatcagcatagggaaatcaaaggaaattccacatgtaaaaccaaataaaaactaaattaggaaagtcccagaaagggatcaattggatttaccaacgcctgg

SEQ ID NO: 17863 - DNA, 126 bp, Homo sapiens
  misc_feature 9, 37, 41, 108: n = A,T,C or G
gttggcatnggtgtaaacaaacaagctaaggcaagantctngccaagagaatgaatgtgcggattgagccattaagcactctaagagcgagatagcttcctgaaacgngtgaaggaaaatgatcgg

SEQ ID NO: 17864 - DNA, 433 bp, Homo sapiens
  misc_feature 251, 305: n = A,T,C or G
gtgggaggctgaaataacagagaactaggaagcctgaaaaccctctgggccctgttcttttaaagcccctttgctttgtaaccttggcccgatcacttccatctcagaacttcagtctccttaactgccaaatcaagtggatgttcaaagacctgtcagacccttacagatgaaccagctgtgccatccatcatgttcatcagctgctctcaacccatagagatcacatgaggtttcgagatttcaggggnctttaacatcaatttataatttaaaaaatttttttcattacataaataaaatgngtttattttagaaaatttagcaattatagaaaccaaaaagaaaatgcacattccctgtaattttactgcccagacataagaaagtggcatatttggcttatttccatagatataaatacttttacccc

SEQ ID NO: 17865 - DNA, 443 bp, Homo sapiens
  misc_feature 33, 235, 333: n = A,T,C or G
aaatattactcctattactgtgatgaacatttngagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgcatcctggctacgctcttccaaaagcgcagaccacagntacatgtatggagaatggctggctcctactcccagatgcatccgggcaagctttaccctctgaacttctgatcgaaggcatccctctccagcttgagnggatcaaagatgacaagggccaatggaaccaagtttgagtcttgccagggcaatacttgggtcctgagatggggactaggatctggtttggtatggggggataattccag

SEQ ID NO: 17866 - DNA, 439 bp, Homo sapiens
  misc_feature 222, 275, 373: n = A,T,C or G
tagagtcagagttgacttctacccgccagcacctgtcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggnggttgatcttctggcattaagggaaagatcgaactggaagaaacaattaaagnatggaagcagcggacacatgttatgcggtcttccatgaacagaagcgccaaggccaaaggattcctatccaagtctatgtggccacgatccatgaagncattcagtggaaagatgcacgttgatactattttaagagccaaataacctcctatacaataaaaaa

SEQ ID NO: 17867 - DNA, 387 bp, Homo sapiens
  misc_feature 21, 24, 131, 242, 246, 254, 261, 319, 350, 355: n = A,T,C or G
attctcaaccatttaagtatnctnggcaggagaacttatctgaatgggccaaggctctttgagttgggagcaaggcgtattttcccacccaatctccatgcacccgggtcctgtggtttcattggcacttnatttggaaagttgttggcttttgggaggagaaaggaaggagaagtttggcagcatcctgttccaaggcctagagttttaatgtgtggcaagactgttattgattaattggntttnaagagggnaacatgntctttcaggacatagggctctaggacaaaaataactttaaaagaagaggtggagatgntagagaacactctaataactcctatcacttnacagntgggaaacctgaacccccaaaggggaaggaga

SEQ ID NO: 17868 - DNA, 169 bp, Homo sapiens
  misc_feature 66: n = A,T,C or G
gtgaacacgatgcaagcccatggtgtttcgggctttttttaaaaaaaaaattgtagcactgggcgnggtgcatgcctgtaatcccagccactcaggaggctgaggcggggaggatccattgagcccagcagtccaacctgggcaaaatagtgagagaccctgtatctga

SEQ ID NO: 17869 - DNA, 268 bp, Homo sapiens
  misc_feature 158, 196, 198, 235: n = A,T,C or G
actaggtaacatgctagtcttatagtgtattggaagaaactaaggcttgttggtgacagcttggtaatagtattctacagattaaagattctctttttcccagtttttggaggggccttttaccatcattttggtgcctttcttatatttccagtttntgaatattaaacgacagttaagattctaaagctctatngnccaatacagcagttaccaagcccctgaaaaatcaggnttttaatcacactagttacatttcaaggctcag

SEQ ID NO: 17870 - DNA, 255 bp, Homo sapiens
caagccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgt

SEQ ID NO: 17871 - DNA, 390 bp, Homo sapiens
  misc_feature 21, 229, 299, 337, 360: n = A,T,C or G
agaagcaagctttgccaactncccaactgtagaggagataaaagagtttatggaccaaagcaaaatgaaggcttatccagataatttaggccaacagcacacccccacctgaattcaccagtgaactgcagacaaagtgtgtctgacggcttgtgttatctggatggctgtcttgttcttccactgtcctttgagtatgtctgcccttttgcattctgattcctttatngccacattgtttaatccaggtgctgtctatgagatttcggggaggggcttgggaagtctggagcaacttntggctgaagagacaaagcattattattattatatgatnatatcaatgtaaggcagagcttntagcttaaggagcacaaccaaaaaaaaaaa

SEQ ID NO: 17872 - DNA, 344 bp, Homo sapiens
  misc_feature 208, 281: n = A,T,C or G
aaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgngaagcaaatcgtaagtatgtacgcacgcatatcaaactatgctctgaggataaagcaaggtctaatttggggnaaaaggattaaatatttctggtttctgaaaagagtattttggattttggtttctattaaaatg

SEQ ID NO: 17873 - DNA, 304 bp, Homo sapiens
  misc_feature 218, 242, 291: n = A,T,C or G
tgttcggtctcaagatttatctggttgagttggtgttttgcctgaggttattaattttgcgtgtttgcatagcataaaatcagtagacaacaccattgaggtcgttacgatcaacgatatccacagtctctttttagctctgttacatgaagtttattccaattacttttcatggatgacctatttggacaagtaattttcttgacaagaaagaatgnatagaagctccctgcaattaattncaatgttacatttttactagactggggaattctacagataatatgaaanggagccatggccg

SEQ ID NO: 17874 - DNA, 264 bp, Homo sapiens
  misc_feature 68, 159, 172, 231: n = A,T,C or G
aatactgtgtatccttttatgggtaaaacaaaagtgaacattgcatgcatgtaatgtgatgaatttgnaatttaggagttctttggggcttctgtgacttgggaaatgcttacattcaggccttaatgttgcattagctagcatgttttccctctgagnatatagtcactgntggataactaatcttgcttggtttctactctgggactttccatatcatatttcattaangatcagtagggcaaggagccaaaacagataaaa

SEQ ID NO: 17875 - DNA, 137 bp, Homo sapiens
ttctgtagtcctagctactcgggaggctgaggcaggggaattgcttgaacccggcaggtggaggatgcagtgagctgagatcgcgccattgcactccaggctggcaacactgcaagtctcggtctcaaaaaaaaaaa

SEQ ID NO: 17876 - DNA, 442 bp, Homo sapiens
  misc_feature 86, 311, 340: n = A,T,C or G
ctcggataattgcggaattctggatgtttaaaaaggggcatatatgtctgtgtggcaatagtatcaataccttcatttttaaaatnaaattgagacattccatccaccaattagtctgaggaaaaaatcaaaagtggttattttatcattaaagatagaacaaaaactagccagcttgtgatttacatataaaaacttgcaaaatgtatgtattttatctaaatttaaataaatgctatctaatactggtaggggtataatgctattaactacttttagaatttgcagatatttgaggtttcttagcatgnagcaacttatttcataatctttaaactgncttttaggactttggacatttaagggatgcctatgtttactaaaattagcaatggaaatctaaaaccaaggtattcttcttggactattatgtcaagaatct

SEQ ID NO: 17877 - DNA, 397 bp, Homo sapiens
  misc_feature 15, 172: n = A,T,C or G
gtatacatcaacatngaagatcttattctaagtttgttcatgctaactttgaacttcagtttggggatcctgatagaatttactttccagagagtttatgagtattttatgagataagatgtgtaaaggacttactgcagtgcttactctttgcttactctttatattttgnttttattttttgagacaggatcttgttttgttgccaggctggagtgcagtgacacaattactgctcactgcaaccttcacctccaggctcaagcaattctccacttcatcctcccggcagctggactacaagctcacaacactacagccagttagtttttctattttaagagacagggtcttgctgtgttgcccaggctggtcttgaacttctggggtcaagcat

SEQ ID NO: 17878 - DNA, 125 bp, Homo sapiens
  misc_feature 16, 27, 41: n = A,T,C or G
ggggaaaagtgggacnaacccacgatnctagagccctgagnatgcctggacattgatgctaacatgaccatgcttgggatgcctctagctggctggggatagctaggagcacttactcaggtggc

SEQ ID NO: 17879 - DNA, 347 bp, Homo sapiens
  misc_feature 21, 271: n = A,T,C or G
cctgctgcagttcaactctgntgtttttcagtcatttcctactgtgagtggagtgatgtttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgnaaagatcttttgcctcaaattggcttatttttctgattatgagggttgaagaaagaatcacctaaaagatccattt

SEQ ID NO: 17880 - DNA, 185 bp, Homo sapiens
tgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgac

SEQ ID NO: 17881 - DNA, 177 bp, Homo sapiens
cttcttcgagcttttgaggttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataaca

SEQ ID NO: 17882 - DNA, 275 bp, Homo sapiens
  misc_feature 23, 247: n = A,T,C or G
ttggggttaagaggaagccaatnatgtccaatcaacacctgatgaacctgatattttcacggggcatttaagcaagctgtaggcatagtcagtaggattctcaattcttaagtttggaggttgggatttctgttgaatgcagactccaggtgtgaggaaggaaattcagatgcatgctacgatatgaatgaacctttgaagacattatgccaagtgaaataagccagtcacaaaaagacaaacactngtatgatttcactcctattgaagtgcct

SEQ ID NO: 17883 - DNA, 165 bp, Homo sapiens
  misc_feature 50, 53: n = A,T,C or G
aaagcatcttaatcagacttatttttaattactgaatatttcttagacgnttngggacagattttatgtaatctttataagtatgatttctgaagaaaagcaaatgcattagtatgtttgccttaaacttgtagactaaaccaagtattgtaaaataaacagcga

SEQ ID NO: 17884 - DNA, 167 bp, Homo sapiens
  misc_feature 26, 28: n = A,T,C or G
tcaaaaatcagtggtacctagagtgngnggccacttcttctcaaatatctgctgtaactagttcttgaccagtttttcccaccaaaactccagaactgatcaaggtgtagtggctcacgcctataataccagtgctttggggaggccaaggcaggaggggtttcttg

SEQ ID NO: 17885 - DNA, 266 bp, Homo sapiens
actaaattactggatgaaatgaaattgttcacttgagggattagtcaaccattggggagtgctcactgtcaaatacagcatgcacggtcctagctgatagaccttttcctcattgctacagcaagccacagggtagagtgaccagttctcctatccaaaaataaatgcgaacatgcatacataaatgtgggcttgagggccacttttgccatcactgtgctccaaaggaacatgatatttgtttaaataattacttgtaccgcatt

SEQ ID NO: 17886 - DNA, 161 bp, Homo sapiens
tttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacact

SEQ ID NO: 17887 - DNA, 140 bp, Homo sapiens
gggtggtgaccaatgcattaccttctgttccttatgatattctcattatttcatcatgactgaaagaagacacgagcgaatgatttaaatagaacttgattgttgagacgccttgctagaggtagagtttgatcatagaa

SEQ ID NO: 17888 - DNA, 143 bp, Homo sapiens
  misc_feature 68, 74, 105: n = A,T,C or G
aaatagttctgccacctctgacgcaccactgccaatgctgtacgtactgcatttgccccttgagccanggttgnatgtttaccgtgtgttatataacttcctggntccttcactgaacatgcctagtccaacattttttccca

SEQ ID NO: 17889 - DNA, 179 bp, Homo sapiens
gccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagccttgg

SEQ ID NO: 17890 - DNA, 133 bp, Homo sapiens
  misc_feature 31: n = A,T,C or G
tgcatgaatgcaaagaagctttttcactatntgacaaagatggtgatggaactataacaacaaaggaattgggaactgtaatgagatctcttgggcagaatcccacagaagcagagttacaggacatgattaa

SEQ ID NO: 17891 - DNA, 199 bp, Homo sapiens
tgctgttaaaggccgatagcgcagacagacagattacacatattttagttttttcccaaaagcttatgaaataatgtaggcaggcagggaacgtaggttcagctgaatgtcattcaggctatttgaacatggattcttattgtagaacaatgtagcattcaaaaaataataaaagaataagctctcctcaagattgaaa

SEQ ID NO: 17892 - DNA, 360 bp, Homo sapiens
tctgtattgtacatgcatgcctttcgcctgtttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagtttcaaatgttgttaccagtgaaacacccttgtggtttaaacttgctacaatgcatttattattcatttcctcccatgtaactaagaatcatggctatatttcatatcaacgttatattgaaagtgaagggaatgattaatacaaggttttgtagt

SEQ ID NO: 17893 - DNA, 236 bp, Homo sapiens
cactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatctgtcttttacaatttttttcctttttttttttt

SEQ ID NO: 17894 - DNA, 138 bp, Homo sapiens
  misc_feature 7, 94: n = A,T,C or G
cctttancaataaacgaaagtttaactaagctatactaaccccagggttggtcaatttcgtgccagccaccgcggtcacacgattaacccaagncaatagaagccggcgtaaagagtgttttagatcaccccctcccc

SEQ ID NO: 17895 - DNA, 334 bp, Homo sapiens
gacatacgcgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaggttcttatgagattgtccaaaacaaagaaacatgtcagcaggcctatggtggttccatgtgtgctaaatgtgttcgtggcaggatcaagcgtgctttccttatcgaggagcagaaaatcgttgtgaaagtgttgaaggcacaagcacagagtcagaaagct

SEQ ID NO: 17896 - DNA, 312 bp, Homo sapiens
  misc_feature 15: n = A,T,C or G
cactatataggcatnacatttttgtgtggatatgaaacttaggaaggatcctcttgactccttgtgatgtggcaataaattttttttaaaaagctgaaaatacttaggaaggatccgcataatttttttctgcaacttaaatgaaatgcatcattcttgttaattataccatggtgaattaatcacttttgaagcaatatcagttattttttgaataataacttttctaaagccttaagtcttaatattaaatatatgattagccaggcacggtgctggacacctgtaatcccagcacctttgggaggccaa

SEQ ID NO: 17897 - DNA, 311 bp, Homo sapiens
  misc_feature 296: n = A,T,C or G
gattaggccatgagagcttctccttcatgaataggtataaggcccttataaaagatccttcatgccaggtacagtgacttgcgcttataatcccagctactcagagggctgaggcagaagaatcacttgaggccaggagtttgagaccagcctggaaaccatagtaagaatccacttctaaaaacttaaaaaaaataaataaattagccaggcatggtggcatgtgcctgtagtcccagctactcaggaggctgaggcaggatgatcctttgagttaaggagttcgtggcttcatngagctatgatcacat

SEQ ID NO: 17898 - DNA, 396 bp, Homo sapiens
  misc_feature 14: n = A,T,C or G
tgccgcagctaganatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcaagaagattcaagcagctcacagccctgggggcagctcaggctactgctaaggcctgagagtttttgcagaaatggggcagagggacaccctttgggcgtggttcctggtgatgggaaagggtcttggggttttaatgccaataaatgtgccagct

SEQ ID NO: 17899 - DNA, 255 bp, Homo sapiens
  misc_feature 20: n = A,T,C or G
cacaagaagaaacgcctggngcagagccccaattcctacttcatggatgtgaaatgcccaggatgctataaaatcaccacggtctttagccatacacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 17900 - DNA, 310 bp, Homo sapiens
  misc_feature 89: n = A,T,C or G
gccaactatgcctctcagaacatcacctaccactgcaagaacagcattgcatacatggatgaggagactggcaacctgaaaaaggctgncattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattgcccagctgt

SEQ ID NO: 17901 - DNA, 387 bp, Homo sapiens
atggtttgcacagtgactttgtttttatctgtgctcaggcatgattacagtatctcattttatccggattacagtgacctcatctgatgttagagatttgagaattgttaaatgttcagcaggagaacgccaccgctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaataggggaaagaaaagcattaagttacttatagtccataaagggcctacattattttgtactctgataatcccataaaacaaagttttaagaatg

SEQ ID NO: 17902 - DNA, 242 bp, Homo sapiens
  misc_feature 49, 60, 94: n = A,T,C or G
ttaccctataagaacttattatacaacacattggagagacagccaaganagctaagttgncattagattaaaattatatgaataatatgaaggngtgaagtgagtcttatataacaaaagccttatattaacccaagatgtagatcatcttttatactgctactctgtacgacttttatggttcataataaatgcttttatttttcatgattcacctaacaatattttctttatctagctac

SEQ ID NO: 17903 - DNA, 210 bp, Homo sapiens
tgtcctaatggaactgcaagactgtgcccttcccctcctgaaagatgtcatcgcaacagataaagaagacgttgccttcaaagacctggatgtggcattcttgtgggctccatgccaagaagggaaggcatggagagaaaagatttactgaaagcaaatgtgaaaatcttcaaatcccagggtgcagccttagataaatacgccaagaag

SEQ ID NO: 17904 - DNA, 142 bp, Homo sapiens
tagcagactcattatagagaacaagtttgccttgattttgtttaaaatgacttctgctaagcacccagaagataaaattgacatatttttataatataagcatactttttttgacattgtgttcattcttgaataaaatgag

SEQ ID NO: 17905 - DNA, 380 bp, Homo sapiens
  misc_feature 35, 151, 276, 353: n = A,T,C or G
accttctgcataatgaattaactagaaataacttngcaaggagagccaaagctaagacccccgaaaccagacgagctacctaagaacagctaaaagagcacacccgtctatgtagcaaaatagtgggaagatttataggtagaggcgacanacctaccgagcctggtgatagctggttgccaagatagaatcttagttcaactttaaatttgcccacagaaccctctaaatccccttgtaaatttaactgttagtccaaagaggacagctctttgnacactaggaaaaaaccttgtagagagagtaaaaaatttaacacccatagtaggcctaaaagcagccccaattaaganagcgttcaagctcaacacccactacct

SEQ ID NO: 17906 - DNA, 198 bp, Homo sapiens
  misc_feature 121: n = A,T,C or G
aatagcttaagattttaagagaaaatatgaagcttagaagagtagcatgaggaaggaaaagataaaaggttctaaaacatgcggaggttgagatgaagcttcttcatggagtaaaaaatgnatttaaaagaaaattgagagaaaggactacagagccccgaattaataccaatagaagggaatgcttttagattaaaa

SEQ ID NO: 17907 - DNA, 341 bp, Homo sapiens
  misc_feature 266: n = A,T,C or G
ctatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggntatcctttgtaaactacctctgtactccacaggctgatgatatgtgatatccctatatcattaaagtaaagccta

SEQ ID NO: 17908 - DNA, 198 bp, Homo sapiens
  misc_feature 29, 151: n = A,T,C or G
gtatagtgaacatatttaatttgtcaggngacttgagatgttaccatatcctaggatacttattttcgatatttctctaatgtgtaagtagatatacttgttggatgtgatacagtatgaagcctggctaattttgtcatctaaaggtatnatgtgtaaggaataaacacatttccatttattaagaattcaagatgc

SEQ ID NO: 17909 - DNA, 290 bp, Homo sapiens
ggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactagggtgcaactgtgaaggaaaaactttcttctttaaggattctcagtaccggcgttttaccaatgatataaaagatgcagggt

SEQ ID NO: 17910 - DNA, 341 bp, Homo sapiens
aaactgagcatagagtgtatggaaattctgtcctatcatcacaattttaaaactactctaggccaagcacagtggctcacacctctaatcccagcacttcaggaggctgaggttggggggatcacttgagcccaggagttcgagaccagcttaggcaacatagggataccctgtctctataaaaataaaataaataaaattaaaactactccaaaggaaaaaagttattaagaaaaagaatgtatggggataaccatctttagaaaatacaacctgccacgcttagtaactctgattatatgattcaaccttagtagatctcactgtctttatctttaaag

SEQ ID NO: 17911 - DNA, 190 bp, Homo sapiens
  misc_feature 17, 69: n = A,T,C or G
aattgtctgtgaactgnagatgatccatcctcactggctttataccatattgttccagttagagttggnaaattacaataaaccagtgtcattccatttccaaatagagtttgaaatgatttaggaaacactcacttacattagtagtgtatacttttaaaagtgaaagtacctgtaattccagcacttt

SEQ ID NO: 17912 - DNA, 336 bp, Homo sapiens
ccaccaccatgtctgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgcttt

SEQ ID NO: 17913 - DNA, 196 bp, Homo sapiens
gccactcaccaccttcctcatcagagaatagtgtgtgtaatgctcaggagttcacagggatgcagtaggtactcaatacttacctgctgtgtccaaatggctgggcgacttctggaagcattctgtgccctggcagcaaattcctgaggctgattgacccctgtggggagagtgggaagaactggagggaaaagag

SEQ ID NO: 17914 - DNA, 149 bp, Homo sapiens
  misc_feature 5, 99: n = A,T,C or G
aaagncttctttcatgtaagtagcaaacagggctttactatcttttcatctcattaattcaattaaaaccattaccttaaaatttttttctttcgaagngtggtggcttttatatttgaattagtaactgtatgaagtcatagataata

SEQ ID NO: 17915 - DNA, 312 bp, Homo sapiens
caagaagtcccattgcagacttccaactttgcccatgtcatctttcaaaatgtggccaagagttaccttcctaatgcacacctggaatgtcattacaccttaactccatatattcatccacacccaaaagattgggttggtatattcaaggttggatggagtactgctcgtgattattacacgtttttatggcccctatgcctgaacattatgtggaaggatcaacagtcaattgtgtactagcattccaaggatattaccttccaaatgatgatggagaattttatcagttctgttacgttacccataagg

SEQ ID NO: 17916 - DNA, 124 bp, Homo sapiens
  misc_feature 103, 104: n = A,T,C or G
gtatgggtctcatcattcccatacacagaaacacaaaacactttgatcataaacttttttcttcagaagccaaactaacttgcagaataatagagccactggnntaatgtttcctcaagatagg

SEQ ID NO: 17917 - DNA, 120 bp, Homo sapiens
  misc_feature 69, 100, 103: n = A,T,C or G
atagattaaaaaaactgatcctgaaaaataaattaattgcaaaagcattatataaagaagcccaaagcnaaatataattctttccctctgttaggggcancangctactcccctgcgtca

SEQ ID NO: 17918 - DNA, 190 bp, Homo sapiens
  misc_feature 55, 57, 113, 167: n = A,T,C or G
gcaggcaaaacaaatgtaatgttgcagatccgcagcagaagctctgcccttctgnancctatgtatgtagtgtgctttttcttgccagcttgggccattcttgcttagacagncagcatttgtctcctcctttaactgagtcatcatcttagtccaactaatgcagncgatacaatgcgtagatagaaga

SEQ ID NO: 17919 - DNA, 330 bp, Homo sapiens
  misc_feature 23, 174, 178: n = A,T,C or G
gaaagatagagattaatacaacnacttaaaaaatatagtcaataggttactaagatattgcttagcgttaagtttttaacgtaattttaatagcttaagattttaagagaaaatatgatgacttagaagagtagcatgaggaaggaaaagataaaaggttctaaaacatgacgnaggntgagatgaagcttcttcatggagtaaaaaaatgtatttaaaagaaaattgagaagaaaggctacagagccccgaattaataccaatagaagggcaatgcttttaggattaaaatgaaggtgacttaaacagcttaaagtttagtttaaaagt

SEQ ID NO: 17920 - DNA, 391 bp, Homo sapiens
  misc_feature 20, 28: n = A,T,C or G
aaaaaagagacaagggaggntattaagnaatgacaaacgggttaattcagtaagagtatgtaacaatcacgtatattcacccaacattcaatcacacatacacacgattggtctatctttttgcatttagatctataatgcatgcattttctctaaagagagaaattgattgcaatacactaatactaaggaactttaacccccctcccccaacttatagcaacagacaggtcatccagacagaaagtcataaaagaaacaccaaatttaaactgcatcctagaccaaataaacctaataaaagtttgcacatttcatccaagaggtgaagaagatacattcttctcaactgcacgtggaacattctccagaacagactatatactaagcc

SEQ ID NO: 17921 - DNA, 371 bp, Homo sapiens
  misc_feature 5, 14, 38, 44, 70, 203: n = A,T,C or G
caacntggaccgancgctagccaagtgcattataaggngaatgntgatgaattgttccttaatctccatncttcttccatctgcaactgatactatgcggtcctttagtgctgatcatatttctgttctaaatacttggtgcacaataggtactcagtaacagttctttgattgggtgaatggatgagtgaatgaagacagangacaggctttaaacttttttaaagtatggtttaagaagaaaaaggagtgtagttttgcatgtctttgcaagggtaaaatttatttcatttttacataagagtaaggagaattgggagccgaggtgagaggatcatgaggtcaggagatcgagaccatgctgctaacac

SEQ ID NO: 17922 - DNA, 122 bp, Homo sapiens
  misc_feature 89: n = A,T,C or G
cttactcccagcaccaaaaggaattgaccagcctcaacacaatctcggacaaagctagtaactgaacacagggctgctgccccacactnctctttctcttgtaactgcacaatagcagaaaa

SEQ ID NO: 17923 - DNA, 260 bp, Homo sapiens
  misc_feature 130, 166, 247: n = A,T,C or G
ttgtctcccgcactttgccagatgagagcacagcattggttaacatttctctgctgatctatactcttcaatggctccccgttacaaataaaggaaagatgaaacttcttagggtggcattcaaggcttntcaggacctccaaactcttcctttcctccctctttnccatattgagaagactgtgccatattctctgaacctattttatctgttcccatgcccaggccttggtcattggcatactgnatgttgtatttag

SEQ ID NO: 17924 - DNA, 379 bp, Homo sapiens
  misc_feature 7, 47, 308: n = A,T,C or G
tagtggnaagatttataggtagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaatcccaaacatataactgaactcctcacacccaattggnccaatctatcaccctatagaagaactaatgttagtataagtaacatgaaacattctcctctgcataagcct

SEQ ID NO: 17925 - DNA, 133 bp, Homo sapiens
ggcgcgtgcctgtagtcccagctactcaggaggctggggcaggagaatcagttgaacccaggaggaggaggttgcagtgagccgagattgcgccactgtactccagcctggcgacagagcgagactccgtctc

SEQ ID NO: 17926 - DNA, 340 bp, Homo sapiens
  misc_feature 59, 61, 306: n = A,T,C or G
ctagcagaatccgcaaacttttcaatctctctaaagaagatgatgtccgccagtatgtngnaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagctnctacttctaagtctgaatccagtcagaaagaaga

SEQ ID NO: 17927 - DNA, 200 bp, Homo sapiens
  misc_feature 90: n = A,T,C or G
taatattatatttttggatgattagaaaaatataaaaatgagtaaaagaattttcaataatttggatcaaaatccctggaattagccagnaacagtggatcatgcctgtaatcccagcattttgggaggccagagtgggtggatcacttgagctcagcagttccagaccagcctgggtaacttagtgaatccccatctct

SEQ ID NO: 17928 - DNA, 291 bp, Homo sapiens
  misc_feature 32, 185, 197, 237, 242, 279: n = A,T,C or G
cttgttattttttacttgaagcattttggganggtctaaacagggaagagagagggtgggggagaaaatgtttttttctaagattttccacagatgctatagtactattgacaaactgggttagagaaggagtgtaccgctgtgctgttggcacgaacaccttcagggactggagctgcttttanccttggaagagnattcccagttgaagctgaaaagtacagcacagtgcagctntggtncatattcagtcatctcaggagaacttcagaagagctngagtaggccaaa

SEQ ID NO: 17929 - DNA, 269 bp, Homo sapiens
agaaggatggattggtacatcttaaaagacttgtaagatagcgaaggataggcagtgctaatgaccaacagcaacactcagcaggactttgtggaccaaaaaacttcaagttagaattgtgggtaaaggctgggcatggtggccctcacctgtaatcccaacactttgggagcctgtggtaggagcatcacatgaggccaggagtttgaggtttaagttacctgcagtcataccactggactcctgcctggtaacagacgctgtctctt

SEQ ID NO: 17930 - DNA, 319 bp, Homo sapiens
  misc_feature 183: n = A,T,C or G
ctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgnctttcagcaaggactgggctttctatctcttgtactacactgaattcacccccactgaaaaagatgagtatgcctgccgtgtgaaccatgtgactttgcacagcccaagatagttaagtgggatcgagacatgtaa

SEQ ID NO: 17931 - DNA, 220 bp, Homo sapiens
  misc_feature 17, 45, 105, 180, 200, 208: n = A,T,C or G
gctgctaacactgaggnagctctcttcatcttatttgcaagcggncctgtagatggcagtaacttgatcatcactgagatgtatttatgcatgctgaccgtgtgnccaagtgagccagtgtcttcatcacaagatgatgctgccataatagaaagctgaagaacactagaagtagctttntgaaaaccacttcaacctgntatgcttnatgctctaaaaa

SEQ ID NO: 17932 - DNA, 430 bp, Homo sapiens
  misc_feature 404: n = A,T,C or G
acccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgtcaagctcaacacccactacctaaaaaatcccaaacatataactgaactcctcacacccaattggaccaatctatcaccctatagaagactaatgttagnataagtaacatgaaaacattctcctc

SEQ ID NO: 17933 - DNA, 353 bp, Homo sapiens
  misc_feature 39, 69, 89, 90, 91, 136, 140, 165, 196, 234, 254, 262: n = A,T,C or G
agagtaaaaaatttaacacccatagtaggcctaaaagcngccaccaattaagaaagcgttcaagctcancacccactacctaaaaaagnnnaaacccactccaccttactaccagacaaccttagccaaaccattnaccnaaataaagtataggcgatagaaatngaaacctggcgcaatagatatagtaccgcanggaaagatgaaaaattataaccaagcataatatagcanggactaacccctataccttntgcataangaattaactagaaataactttgcaaggagagccaaagctaagacccccgaaaccagacgagctacctaagaacagctaaaagagcacaccc

SEQ ID NO: 17934 - DNA, 342 bp, Homo sapiens
gtgcatgtcatcacaaacatttgctcttaaggtacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgcaagcggcatccaccaagcatcaagttggagaaaagggaacccaagcagtagagagcgatattggagtcttttgttcattcaaatcttgga

SEQ ID NO: 17935 - DNA, 191 bp, Homo sapiens
taattgcatattgcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcaca

SEQ ID NO: 17936 - DNA, 341 bp, Homo sapiens
tgctctcagttcaaacgaaagtttctgttacatttcacctacctacagccttacctcactcagctagcattagactactcagcaatgagttccaacattgccttgctaaaaagcaaggtggctcacaaacaagacttcagcaaagatagcattaaaatgtgaagtctgcatttgttcaaggcataccttagatggagtaattcatggccaagcaatgctgcaggtgtggtcagcacatgtagttgataggcagactcctattattttaaacaaacaaaccaaaaaagttttttaaaaaatgagacccaccttcatcttgaatatgtcaaccccgcaccacc

SEQ ID NO: 17937 - DNA, 176 bp, Homo sapiens
  misc_feature 130: n = A,T,C or G
ttcattgagcagttagctcatttgagataaagtcaaatgccaaacactagctctgtattaatccccatcattactggtaaagcctcatttgaatgtgtgaattcaatacaggctatgtaaaatttttacnaatgtcattattttgaaaaaataaatttaaaaatacattcaaaaat

SEQ ID NO: 17938 - DNA, 196 bp, Homo sapiens
  misc_feature 10, 37: n = A,T,C or G
cagtcctggnggacctggtgctgctggcttccctggngctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagc

SEQ ID NO: 17939 - DNA, 217 bp, Homo sapiens
  misc_feature 54, 56, 118, 124, 138, 144, 163, 171: n = A,T,C or G
gatggtgctattgggggcactatgaggtatagacttgctcttgattttctttcncnttacctagagaatttacttctgtcttcaattctcacaccctattcatatcttttgttgaatngtgatnccctttctttgttntgaaanatgaaagaaatctctaaancaggttcngacagatgggtatggataaccatacccatcctaggtattattagca

SEQ ID NO: 17940 - DNA, 154 bp, Homo sapiens
  misc_feature 63, 73, 74, 131: n = A,T,C or G
cattagaaactatccctaaatgtaaagatcttttgccttcaaatttggcttattttttctganttatgagggnntgaaagaaagaattcacctaaaagattccatttccagttttataatgtatttcaggnctgaataacaatatttttccaaa

SEQ ID NO: 17941 - DNA, 305 bp, Homo sapiens
  misc_feature 114, 115, 145, 165, 191, 227, 231, 279: n = A,T,C or G
tgttttctctttgaaagatagagattaatacaactacttaaaaaatatagtcaataggttactaagatattgcttagcgttaagtttttaacgtaattttaatagcttaagacnntaagagaaaatatgatgacttagaagagtngcatgaggaaggaaaagatnaaaggtttctaaaacatgacggaggntgagatgaagctcttcatggagtaaaaaatgtattnaaangaaaattgagagaaaggactacagagccccgaattaataccaatagangggcaatgcttttagattaaaatgaa

SEQ ID NO: 17942 - DNA, 377 bp, Homo sapiens
  misc_feature 193, 362, 367: n = A,T,C or G
gcagagcagtcatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgnatcataagttcagcctgcatactttttgcattgatcggtatgaataccagaccatttgtaagtgtgggtggaagagcaaaatgctaattgacatctctagtaaatactgtacaggattcatgaccttgaataatctacagttgaaactctgatgctatatatacatggnataanggattcagac

SEQ ID NO: 17943 - DNA, 253 bp, Homo sapiens
  misc_feature 21, 225: n = A,T,C or G
ggaaaaatgaaatttagtagntccaagtttcaaagaaatgtcaacattttattccattcaataaagaacaaaaccgatagtgtttttattactttcatctgaaacattccatgttttaatctgagccttgcagactttcatttggagtttgaacccgttttggttgcatttcatttttggagaacttaattaacgtgagattggcaattgaaatgcaggtgcagntttctgttaatgcatgctgttgtttagg

SEQ ID NO: 17944 - DNA, 180 bp, Homo sapiens
  misc_feature 80, 114, 148, 166: n = A,T,C or G
ggaaaagtatataaaccgtgattattcaaagattttcactgaaaatatagttgaacagccctgtccagatgtcttttggntccccatattttctgaaaaagcctgtgatgaatnggtagaagaaatggaacattacggcaaatggtcngggggaaaacatcatganagccgtatatctgg

SEQ ID NO: 17945 - DNA, 358 bp, Homo sapiens
  misc_feature 316: n = A,T,C or G
aaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaggagaggtggcagcattcagcagtatatttataaacaggaacctgtacagaagtgccctggaagaaggcctgctctaaattatccagtgtatggagaaacgacacaggttaggagacgtctgctttgaacgtgctataggaccttctcaaacacacaccatnagaattcaatattcacctgccagactggcttatcaagacaaa

SEQ ID NO: 17946 - DNA, 342 bp, Homo sapiens
acccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttgggcactaggaaaaaaccttgtagagagagtaaaaaatttaacacccatagtaggcctaaaagcagccaccaattaagaaagcgttcaagctcaacacccactacctaaaaaatcccaaaca

SEQ ID NO: 17947 - DNA, 320 bp, Homo sapiens
  misc_feature 36, 37: n = A,T,C or G
cgcagagctgaagatcaagcgcctgataaagaagtnngcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgcttcgtcaaatcttcaatggaacctttgtgaaactcaacaaggcttcgattaacat

SEQ ID NO: 17948 - DNA, 118 bp, Homo sapiens
  misc_feature 26, 52, 80, 99: n = A,T,C or G
ttcaacctttacatctagaataattngcatctcattttgcctaaatggggcngaattcataaacactttccacatagaanatagattagtattacctgnggcaccttttaagaaaggg

SEQ ID NO: 17949 - DNA, 348 bp, Homo sapiens
  misc_feature 255: n = A,T,C or G
attattctgctgtggatcccactaaagatatattcactgggcttattgggccaatgaaaatatgcaagaaaggaagtttacacgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactgtaagnactgcatcatccaccaatctaccaagttattttagtactgcatatgtaatgcttttaactaaacaaaatgtgaagagctttgctcattgatta

SEQ ID NO: 17950 - DNA, 209 bp, Homo sapiens
  misc_feature 169: n = A,T,C or G
tgtcttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggncaaaggagagtcaacatatgtgattgttccataataaact

SEQ ID NO: 17951 - DNA, 231 bp, Homo sapiens
gagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtgcaagtgaatttgcctgtaacaagccagattttttaaaa

SEQ ID NO: 17952 - DNA, 227 bp, Homo sapiens
  misc_feature 28, 29, 30, 45, 70, 107, 125, 132, 148, 193: n = A,T,C or G
tgtgaattatagctaaacatctgggcannnataaactataaaaanagaatctttgcctattaagcatttnaatattcaaaagcttcaatcatccttatgtacaaagngaattggaaatatcatcnttatttnctggttcactgatagnggaatcttgaaagcattcatttatctttctatgtcaaaaatactncagaatacaaatatttcaggcactagaaacctag

SEQ ID NO: 17953 - DNA, 212 bp, Homo sapiens
  misc_feature 181: n = A,T,C or G
ttaaatgtagttttgctaaagggtaggatttctaaagagtaggtaataagcattacaaattggagggcattgaatttttcttcctttgtaatttgttcattcattcattcatttattcatgcattcaacaactatttatcaaacatgagctgtatgtcagtgccaggcaggcagaatgctntatataggaaatacaagaatatatatgatag

SEQ ID NO: 17954 - DNA, 381 bp, Homo sapiens
  misc_feature 260, 292: n = A,T,C or G
gcgagaacctccaaacaaactctcaagaactagggagaggagagtgaaaattaacctagttacaatgattgtatccttacattcttttataaatttcaaaatacttctacatctcctacctcattagtccaaaccacagctctgctgttatccatccccatgttagagatgaaaaaaatcatggctcagagaaagtttggagactttccaagatcacaaaatcaataattctgttaatctcatctctgtagtttattggngaatagttttggagtcagacaaaatcaggttnaaatcctgctacggttactagctgtttgaatacagacaaaaaagtttcctaaatagtaccgcaacttgtagcatagagacaaaatcata

SEQ ID NO: 17955 - DNA, 343 bp, Homo sapiens
atcctttcccacccaagtgaattgaatttttatgttcacaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattatgggatcccatttataggacattctagaaaaacaaaactacagggacataaaacagatcaatagctgccag

SEQ ID NO: 17956 - DNA, 392 bp, Homo sapiens
  misc_feature 380: n = A,T,C or G
ggagaggagattttcatgggtcacaaaattcttggaggtcccttagtagatttggtagttccttaagagatccacgtgataaaataaatggagttggcctttcttgttttttacaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggtcccttttaagtattatttaatagttgaggccagatacttacatgcaagtctgggttatgggttgtttgcctttctcagcttgtgaagncattctaaagct

SEQ ID NO: 17957 - DNA, 381 bp, Homo sapiens
  misc_feature 277: n = A,T,C or G
atagtaacttaggtcaagtgtagttttatatagtggtaggtctgaatccattttctttaactgtgttgttgttgtaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtgggaagctttattctattctgcagggagattctccaactaaatggcgggcnggaagattttcgtatgttcaaaaatggatctttttggaggccaccaccattaaatccgacttgcatggaatgcagaagagcaagaacagaagcttttgtagagg

SEQ ID NO: 17958 - DNA, 138 bp, Homo sapiens
ggggagtttcatcctagcggtttgcctgagaatacagatcaacccacagaacaaagcggatttccaaggcatctccccagagcgagcctttgctgattttctctttgccagcaccatcctgcaccttgttgcatgaac

SEQ ID NO: 17959 - DNA, 242 bp, Homo sapiens
cttaagaagtcccagagttgttctcttttccaagtataaaggggagcccagctggagaattcaaaggattcaaaacattaacttgcctgaacgtatcctgtagcacaaagaaaaaaattaaggagtattttaaagatacttgaaaacttctaaatatattttcacatgtttttccacctgaaagaatctgtccaaggctgccctgagatgctttttggcgaattctaaggtagatcattaat

SEQ ID NO: 17960 - DNA, 328 bp, Homo sapiens
gaatgatttcctaataaaacataaacaaacaaaatttattagagaagaagagaatataaatatactcatgatcttagaagaaaatttaaaagttgtcaaagctctcccaaaatgtgtctagattttacaagctaattccatgagaacttcatggagcacatcattgccatgtggtttagactgttccagggcataggaaaaaatggagcatgattcacttaattttgccaaagtagcataatcttggtatcaaaacttgtggcagaaatctactaaaatcgcagatgtgaatatggtccaagaatcccaagtaaaatactaacaaacc

SEQ ID NO: 17961 - DNA, 287 bp, Homo sapiens
  misc_feature 265: n = A,T,C or G
tacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttagttagtatttgtgtagttcaaaccaggaaggatttgctatcattagattttgcttactttatgaaagctaaaatattctctgttataaagggcactccatctggncctatagcatctttactactga

SEQ ID NO: 17962 - DNA, 116 bp, Homo sapiens
  misc_feature 62: n = A,T,C or G
agagatgaactctatccagccccttaattggcaggtgtatgtgctgacagtactgaaagctntcctctttaactgatcccacccccacccaaaagtcagcagtggcactggagctg

SEQ ID NO: 17963 - DNA, 277 bp, Homo sapiens
cagttcgtttctcactgttttggaaagccctgtgtgccaaaccaaggacgtgtctttcagggaaaggttaattttccgaagtttattaaaatagaacttggaaaaccaagcattttgaatttattccagtcctctgggcatcattcctatttcttctgccatgtcaaggagaaattccaagcctgcattctgtcatgctaaaataaccagcccatacttctcggtgaccttctgttgaacgtacctgagcctgcaaatgtaaaaatgattgtatctg

SEQ ID NO: 17964 - DNA, 450 bp, Homo sapiens
  misc_feature 31, 32: n = A,T,C or G
tttccgatgagaccaatatatgcaatggtannccagttttatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggctgaatctgtgtattttttcaagagaggtgcagcattcagcagtatatttataaacaggaccctgtacagaagtgccctggaagaaggcctgctctaaa

SEQ ID NO: 17965 - DNA, 352 bp, Homo sapiens
  misc_feature 204, 277, 316: n = A,T,C or G
gctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagnaaatatatatgtcaatatttaggaaagcttttcttttttaatttccaggaaaaaataaaaagagtatgagctnctgtaattcattgagcaggtagctcatttgagataaagncaaatgccaaacactagctctggattaatccccatc

SEQ ID NO: 17966 - DNA, 348 bp, Homo sapiens
gaagacatgcccactgttgctacgggtcttcaccaccaataacggccgcaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctgctatcgagttaaggagattggcagcaccatgtctggcagaaaggggacttgatgattccatgaccctgcagtcgcagaagttccagataggagaatacttggacatagcaattacccct

SEQ ID NO: 17967 - DNA, 132 bp, Homo sapiens
aggaacagctctttggacactaggaaaaaaccttgtagagagagtaaaaaatttaacacccatagtaggcctaaaagcagccaccaattaagaaagcgttcaagctcaacacccactacctaaaaaatccca

SEQ ID NO: 17968 - DNA, 284 bp, Homo sapiens
  misc_feature 74, 75, 76: n = A,T,C or G
atccagggggctattgctgcggaccacgccaggcccttagttcagactcctggtgccaccaacaatgcttattnnntatgctgttttgagtttgaaagcaaaagagtcttaaaaaggttagattaagatgtgtcttaaggaaagatatactaatatcggtcagggtcattgcagatgcttaggttatgtgcaataaagccgaaacacaaatccctccctgaataaagaaaccatgttggcactaagatcagtccttgaacataacagaaggtataacttgcaag

SEQ ID NO: 17969 - DNA, 316 bp, Homo sapiens
  misc_feature 222: n = A,T,C or G
ttttaagcatttaaatgaaattgatctttttcactgtattgatacaaacgattccaagcataaaagaacggacagatcaattttatgttgtttacgaaaaggagaatctggacagtcatggccaaggttaacaaaagaaagggcaaagcttaattggcttagtgttgacttcaataattggaaagactgggaagatgattcagatgaagacatgtctaattntgatcgtttctctgagatgatgaataacatgggtggtgatgaggatgtagatttaccagaagtagatggagcagatgatgattcacaagacagt

SEQ ID NO: 17970 - DNA, 338 bp, Homo sapiens
ccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactactt

SEQ ID NO: 17971 - DNA, 412 bp, Homo sapiens
  misc_feature 265, 343, 395: n = A,T,C or G
ctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaattagngttttttatttctactgcaaatgatgtgcaaaacctttactggtgatggaatcagcaggttataatccttaatctaangtcctcaagctggataaatacatatggagtactctctggaccaaatatctgntacatcaaattggctgg

SEQ ID NO: 17972 - DNA, 190 bp, Homo sapiens
ccggacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcgg

SEQ ID NO: 17973 - DNA, 153 bp, Homo sapiens
cgaaactccgtctaaaaaaagaaaatagctaggcatgggcacttgtaatgcatgcctgtagtcccagctactcgggaggcagaggtgggaggcttgcttgggcctggggggttatgcactccagcctgggtgacagagtgaggctccgtctcc

SEQ ID NO: 17974 - DNA, 329 bp, Homo sapiens
catgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttggttttattaaaatgcattttttattcttaagtgg

SEQ ID NO: 17975 - DNA, 152 bp, Homo sapiens
  misc_feature 16: n = A,T,C or G
aagatgatgtagcttnggttcagagagcccaagtctcttcttcggcctctcaaacatggtaccatccctaatgaagtcaacgggtccagcatgacaggatggaagtacaagtgtcagcacctatgtgagtcccaagaggggaaattagaaac

SEQ ID NO: 17976 - DNA, 274 bp, Homo sapiens
  misc_feature 36, 37, 117, 119, 121, 158: n = A,T,C or G
gctacattgccaggttggtcaccttgttgcatgtgnntcacgtttacccaaagaagtaccctattgcttatgagactatgctttgaatagtcccaagatattttcccacccttcctntntnaagttatctattcctgcattaaaaaccactgcagggntaggcatggtgacttatgcctgtacccaacactttgagaggctgaggtgggaggatcacttgagcccaggagtctgagaccagcctaggcaacggtgacaccccatctctacttac

SEQ ID NO: 17977 - DNA, 294 bp, Homo sapiens
  misc_feature 30, 31, 134, 135: n = A,T,C or G
caacaggattcagaaatacccaggaagaannctgcatgcttaaatacatagcatcctactgaaagaaagtgtctattaaaaacacagtgtagttgaacagctgagaaagcaaatttccattcattccccctatnnaaagatatcaaagataaaactgtcaccatgacaaagcattattttttcaaagtaaaataataataataataataaagcaattacatacacacagaaaaagtgggggcttttcagtctctgtaagacttttcagtacttagttgaactaagaaagcacag

SEQ ID NO: 17978 - DNA, 406 bp, Homo sapiens
  misc_feature 216: n = A,T,C or G
atacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagttttngctgacacagaacaaacctgaaagtagtatctactttctaaatactactttgcttttcagtagtggatttgatatttataatgttctctaaagctgcaactttttcagcaacgtttaaaaatagattaacctggaataacttacttgtttgctgctaaaatactcaagattttgccatttttaaacaacc

SEQ ID NO: 17979 - DNA, 287 bp, Homo sapiens
  misc_feature 125: n = A,T,C or G
gattatagattaaagccttttaaggaacatgatgaagaactaaattactgctaaatcacttgaaaaatttatatttttttatgcaccagtcttataacagtaggttttttatagacctattaatngatatttaaaataataactttaataggatgattttgtagagttagtcaaagtgattgacaaaagcaaattattaaaatagtcaaactttcaattctccaaagaatgttcagttttaaaagcaatatgagatacaggaagtattaaactggagatgtaatgcc

SEQ ID NO: 17980 - DNA, 182 bp, Homo sapiens
  misc_feature 6: n = A,T,C or G
cagacnttatttattaagtgcctacctgatatgaatccctaataatgagaccaagctcttcttgggcaataaaactctgaatattgcacatttactcttggaatcactggatttttgaaagtcagagtatcttcttttataggtacctcgaccccagtgaagctctttttttttctcctgag

SEQ ID NO: 17981 - DNA, 337 bp, Homo sapiens
cagtagacattgatgaaggttgtgatcaatgattagactctcaagcctgttgtgtttttgatctagccatgcctttcaaccactgtggtgaacatttagctctgaataggctcatcttcttcatatgcacattctatttgtagatgttgctatgaggacagattcatcaaaaatgactgacgtggagtctggggtcgccaattttgcatcttcagcaaggcaggccgccggaatgccttaccagacatccagagttccgctgccacagacggaacctcagatttgcccctcaaactggaggctctctccgtgaaggaagatgcaaaagagaaagatg

SEQ ID NO: 17982 - DNA, 128 bp, Homo sapiens
  misc_feature 33, 54, 108, 113: n = A,T,C or G
ttgcctagaaatatctttctcttacctgggatntatcaatttttcccagtattnttatacggaaaaaattgtattgaaaacacttagtatgcagttgataagaggaanccggnataattatggcgggt

SEQ ID NO: 17983 - DNA, 310 bp, Homo sapiens
aaagagaacagtcgataacagtataatgcaataaaagtcatgtgaggccagggcactggctcacgcctataataccaacactttgaggggccaaggcagaagactcacttgaggccaggagtttgagccagtctggcaacacagtgagaccccatctctacaaatgtatattttttacattagctaggcgtggtggggacacacctgtagttctaactattcaggagacagatgggaagatcacttgagcccaggagttcaagggctgcagtgagccatgattgcatcactcactccactgtgggtgaca

SEQ ID NO: 17984 - DNA, 420 bp, Homo sapiens
agtagttattacctatacaggaaaacagttataataacttgtgcttattttttgatgctctttaaaataatgtattataatatcttgaaacgattcagtttcacttgaagaaaaatgtaataggaaaaacaatctagaaaaatttattaaaaactttcttagttatgagaaagagaacctagagaatataattaaacatgctaacatgttgctgtaatttcctaattctagctagtgttcttattttaataagcataagtgtgccttagtgcgagaagcctggaaatggacttcacatcttgaacttaggatatttacatgtaactactagttgtaccagttacatgtggcttcagttgctaaactggggtctacagaagcactaaattttcccccttatcctcagtcagttgctctaaa

SEQ ID NO: 17985 - DNA, 133 bp, Homo sapiens
  misc_feature 12: n = A,T,C or G
atagtatagccnttcctccactcccaccagacttgctcatttttcgagtttttaactagactacactctattgagtttaattttgtcctctaggatttatttctgttgtcaaaaagaaaaaaaaaaaaaaaaa

SEQ ID NO: 17986 - DNA, 280 bp, Homo sapiens
  misc_feature 28, 30: n = A,T,C or G
cttttaaaaagagattaaaccgaagggnanaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaaccac

SEQ ID NO: 17987 - DNA, 304 bp, Homo sapiens
cacactaaactgatattaacaagtaattgtgctacaacatggtgacatcgtcattaaggtgatggcagtttttcagctccattttaatgttatggggccagcatcatctctgtggtccggggttgggttgaaacgttgttatgaagcgtgactgtattcacatactttgtggacgccaggcacgtggctcacgcctgtaatctcagcgctttgggaagctgaggtgggaggactgcttgaggtcaggagttcaagaccagcctgggcaacatggtgagaccggccccccacccccgaccacccg

SEQ ID NO: 17988 - DNA, 243 bp, Homo sapiens
  misc_feature 21, 23, 193: n = A,T,C or G
gtgtaataaatgacagaactncnaaagtgagaagcatattaaatgtttgatttttaggaagttttaggtgatagccataaaataaaaagctacacacaaagggtaaatggtcactaagtttttcattgtttacatttcaggtttgatttggccaactgtaacttaaatgatgagcatgtcaacaaaatgaacncagatagagttccagatgtgggaaggctttagatttttccctttttttcc

SEQ ID NO: 17989 - DNA, 323 bp, Homo sapiens
  misc_feature 74, 131, 226, 264, 296: n = A,T,C or G
atgagaaagtttcttccactctttgaccgagtattggttgaaaggagtgctgctgaaactgtaaccaaaggagncattatgcttccagaaaaatctcaaggaaaagtattgcaagcaacagtagtcgctgntggatcgggttctaaaggaaagggtggagagattcaaccagttagcgtgaaagttggagataaagtcttctcccagaatatggagcaccaaagtngtctagatgacaaggattatttcctatttagagatggngacattcttggaaagtacgtagactgaaatangtactattgaaatggcatcaacatgat

SEQ ID NO: 17990 - DNA, 250 bp, Homo sapiens
  misc_feature 131, 223: n = A,T,C or G
cctgaattgctatgtgtctgggtttcatccatccgacattgaagttgacttactgaagaatggagagagaattgaaaaagtggagcattcagacttgtctttcagcaaggactggtctttctatctcttgnactacactgaattcacccccactgaaaaagatgagtatgcctgccgtgtgaaccatgtgactttgtcacagcccaagatagttaagtgggancgagacatgtaagcagcatcatggagg

SEQ ID NO: 17991 - DNA, 229 bp, Homo sapiens
  misc_feature 164, 169: n = A,T,C or G
tggctgatcaaagaaagaaggcatacgcagatttctacagaaactatgatgtcatgaaagattttgaggagatgaggaaggctggtatctttcagagtgtaaagtaatcttggaatataaagaatttcttcaggttgaattacctagaagtttgtcactgactngtgtncctgaactatgacacatgaatatgtgggctaagaaatagttcctcttgataaataaacaa

SEQ ID NO: 17992 - DNA, 207 bp, Homo sapiens
  misc_feature 104, 176, 177: n = A,T,C or G
ctttagattttgattgaagcacagtattgcaggtagggcctaatgggggaagatggtaatataaaagcaagaagtatttttttttgtaatgactgaaagctgtnctgtggatgacctaccctttcctttaaacacgattctctcacttccaactccaaacttgctcaactaatccnnaaaaataaacttgagctggaatttgaggct

SEQ ID NO: 17993 - DNA, 450 bp, Homo sapiens
  misc_feature 32, 33, 54, 55, 74, 80, 81, 88, 160, 163, 214, 238, 267,287, 356, 385, 402, 418, 421, 450: n = A,T,C or G
gccaggtggttttatttaccgttgtgttggannaacaaaatagttacatacttnntaatcaatgaaaataatgntatgannatcaatnatgttttatgaaaggactttacatttttaattcatatatgtcaacattaggaatccctcagaaaggaaatantgnggaagtggatttcatggctctgacaatgtattttcaaatatgcaagtgagnaaacctattatacttaattggatnaaatctaaagaaaaaatgatatgcaaagntttaggcttgaaaacatacngggattatatggcttggaatgagaattaatgggaacatactttcataaagctatttttcttggaacatnaaggaatttggtaaaagtttatattcatnggctattactaaaaagncaaaaaccaacagagnagnaaggaggggagaaagggacacttatcacn

SEQ ID NO: 17994 - DNA, 390 bp, Homo sapiens
  misc_feature 251, 259, 267, 306, 336, 355, 364, 365: n = A,T,C or G
aagggcgacggccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggcctcactttaatcctctatccagaaaacacggggggccaaaggatgaagagagcatgttggagacttgggcaatgtgactgctgcaaagatggngggccgangggctatngaagatctgggactcactctcaggagacattgcatcatngccgacactgggggccatgaaaaagcagangactgggcaaagggggaangaagaaagnncaaagacgggaaccccggaagccgt

SEQ ID NO: 17995 - DNA, 118 bp, Homo sapiens
taacagtagcttttgagtaggaaaggactttgatttgtggcacaaaacattattaatatagctattgacagtttcaaggcaggtaaattgtaaatgtttctttaaaaaaaaaaaaaaa

SEQ ID NO: 17996 - DNA, 400 bp, Homo sapiens
  misc_feature 29, 376: n = A,T,C or G
tgagcccaggagtttgagaccagcctggncaaacatagcaagacttcattaaaaatttttaagagaccaggcacagtgtctcatgcctgtaatcccagcactttgggaggcctaggtgggtggatcacttgaggtcaggagtttgagaccagcctgaccaacttggtgaaaccccatctctactaaaatacaaaaattagccgggcgttgtggcaggcacctgtaatcgcaactacttgggaggctgaggcaagagaattgtttgaaccccagaggcgaaggttgcagtgagccgagatcgcgccattgcactctaacctggccacaagagcgaaactctgctcaaaaataaataaagtaattgggccagggcagnggctcatgcctgtattccaagact

SEQ ID NO: 17997 - DNA, 145 bp, Homo sapiens
ctatttttaaaataaatttttctggctgaggcatttttcttgacctggtataatgaaagtatttcagatatttgagtttaacccttttccagaaagtaatacatgatatggatttatttatgcattaaaagagcaaatttaaggc

SEQ ID NO: 17998 - DNA, 311 bp, Homo sapiens
  misc_feature 53, 57, 152, 162, 174, 247, 276, 282: n = A,T,C or G
ttgagtggagaataaagtcaagtataaaaccttaaaaaaaataaactgaagcngggnacaacgactcatgcctgtaatcccagcacttcgggaggctgaggcaggaagatcacttgaactcaggagttcaagaccagcctgggcaatatagngagactttgnctctactaaaanccaaaaaaattaaccaagcatgggggcacatacctgtaatcccagctacttggagaactgaggcaggaggatngcttgagccagggaagtcaaggctgcagnaaaccntgattgtgccactacactccagcctgggt

SEQ ID NO: 17999 - DNA, 278 bp, Homo sapiens
  misc_feature 146: n = A,T,C or G
gtttaatgtgttttgtcaaaagcatttaaccatgttatgatttaagaattctctgttcacttgaggtcaggagttcaagaccagcctggccaatatggcaaaaccctgtctctactacaaatacaaaaattggccaggcgtggtgncgcacgcctgtaatcccagctgctcgggagactgaggcgggagggtcagcttgaactcagaaggcggaggttccagtgagccatcgcgccactgcactctagcctgggtgacagagcaaggactctgtctcg

SEQ ID NO: 18000 - DNA, 372 bp, Homo sapiens
gaagagcagatttgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaagccttggagagaagttaacagatgaagaagttgatgaaatgatcagggaagcaga

SEQ ID NO: 18001 - DNA, 320 bp, Homo sapiens
aggtttgtatgactagattcatatgccagctttattctcgtcctgtgtttggatattgtcgtctgacagggaaggaagctggtcttcagattgttgactgttagccccacacctaggtgagagaaaagcaggggctcagcgaagaccctgagggagctgagaatcagccctggtgaaagtgtgagggtctgtcttttagttaaacacagggtgaagcagttatatgctttaaatgtatgttacaattctacatttgcaagaatgacaagaataatattgcaaactgtggtcactagcaaagaaaggaggagaaagaaaag

SEQ ID NO: 18002 - DNA, 194 bp, Homo sapiens
aaagagaattcgtatgggcactggatgtatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaacc

SEQ ID NO: 18003 - DNA, 155 bp, Homo sapiens
  misc_feature 54: n = A,T,C or G
tgtgtggcacctgggatgaatggtttctggggacatccctgatggcagttttgnggagaggtgcaaagctttatgcggtaagaaatgagctgtagcctcagtgcagtggctcatgcctgtaatcccagcactttgggaggccgaggtgggtgacc

SEQ ID NO: 18004 - DNA, 300 bp, Homo sapiens
  misc_feature 37, 39: n = A,T,C or G
gacttcgaggtgccttaggccgcttgccttgctctcntnatcgctgccgccatggctagtcagtctcaggggattcagcagctgctgcaggccgagaagcgggcagccgagaaggtgtccgaggcccgcaaaagaaagaaccggaggctgaagcaggcaaaagaagaagctcaggctgaaattgaacagtaccgctgcagagggagaaagaattcaaggccaaggaagctgcggcattgggatcccgtgcagttgcagcactgaagtggagaaggagacccaggagaagatgaccatcct

SEQ ID NO: 18005 - DNA, 359 bp, Homo sapiens
agtgatgccgaggttcctttttagaaccaagcaacgccaattaccaacaaaatccgttgcgccgcagtgagttagctaccttctatctccactttgttctgcacgtcgatctcaggagaagccagctcccatgttaagaagttcaaatacctagagactgcgatggtttgcagaggctcaagctaaccacatggaaagacatggagagatattccttgccaaccctcaactactccaactattctaagacatcaaacctgtgagtgaaaaagccatctcataccttacaactctagcagatgccacatagtgtaggagataagctctctctgcattctctgcaaaattgtaaaatcata

SEQ ID NO: 18006 - DNA, 115 bp, Homo sapiens
  misc_feature 19, 28, 101: n = A,T,C or G
gacttctcagccacgtggngtgggcctngcaaaatgatcaagcctttctttcattccctctctgaaaagtattccaacgtgatattccttgaagtagatgnggatgactgtcagg

SEQ ID NO: 18007 - DNA, 325 bp, Homo sapiens
acacctgtatgttgtctgcaggaaaccactttcagcataaagaaacaggttaatgcaaaaagatataccaagttaacactaatcaaaagaaaactggaatagctataaaagtgtcaaatagatttcagagctaggaatattatcaaggataccaagagtcattttacaattttaacttgggcagttcatcaagagaccttaaaaatgctgaatgcatatgtaactaatagtagagcttcaaattacagaaaataaaaattaataaaattaacatgagaagtctacaattacagttggatatttcaataatcctctttcaattatt

SEQ ID NO: 18008 - DNA, 128 bp, Homo sapiens
  misc_feature 89: n = A,T,C or G
aaacaaaacaacatatcatagcagattgaatgcagaagcagatatgggaatccagctgtctcctattaagctaggcattaagagaaatntgtgaagatgtaaaacagtgttactctgaacctgacttt

SEQ ID NO: 18009 - DNA, 181 bp, Homo sapiens
gggggtgggggacagaaaaggagcagtcatgttcctattaaggccttcaaatgattggatgagactcatcaacattaggaaggataacctactttatgcaaagtaacctgctttactcagaaacgtctagaataatggttcaccaaataaccatgttgacacataaattaaccatgagacc

SEQ ID NO: 18010 - DNA, 325 bp, Homo sapiens
aggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacaagcccaagatagttaagtgggatccgagacatgtaagcagcatcatggaggttt

SEQ ID NO: 18011 - DNA, 275 bp, Homo sapiens
  misc_feature 228: n = A,T,C or G
catacagtgtattaaatttactgagtcagcttgctgaataagacagaagcccaagaattttaacagtgtgtagctttagttgtctaaaagttaggccttcgggcttcaaaagttagtggtcatcgaaaagcattaatctttgcagtttcaggtacaacacattggttttgattagggatggggatggggccctctttttgcagaatggggaaagtattgacaggaatngagagctattggaggccagtgtataaggatgtgaaaacagaattaag

SEQ ID NO: 18012 - DNA, 363 bp, Homo sapiens
tttaaaggccaagaaggcagtgttgaaaggtgtccacagccacaaaaagaagaagatccgcacgtgacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcc

SEQ ID NO: 18013 - DNA, 242 bp, Homo sapiens
  misc_feature 26, 33: n = A,T,C or G
cattgtgtttaaaggtctcaagttgnaaacatncatggtactactttgttatctgttaggtccatttcttttccttttttttcttttagatctttagaatttcaaacatgtacaaaaatagattaagtaatgaataaacccctgtgtattcatcatctagtttcagctacacccttgctacttattaatttaaaaataacctaaaaattacattgcaaactagaattttctaggacctgaaa

SEQ ID NO: 18014 - DNA, 300 bp, Homo sapiens
tccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtaagctgacctgcacagattgatgcaatgtccaggatcatttctggggatggga

SEQ ID NO: 18015 - DNA, 490 bp, Homo sapiens
  misc_feature 45, 69, 70, 71, 88, 118, 146, 152, 170, 206, 222, 228, 299,401, 430, 441, 463: n = A,T,C or G
gacagaattttgtcccattgagcctgaaattctgtgagacacatntagaaggctcttagctatacatgnnngaagctcaagaaacatnttggttatatatatagagagagagagagangtagagtcaccagcatataatgagaacngaagtntcaggagtaagcaacaangcttacagaatttgtggtgggagaattgggataatnactgagccctgaaaancatcancatttaagaaccagggagaggagccacgaaggaaagcaaacaactgaagacaaaaggcattcactggtgtntaaatgctgggaatttatagtttgtccatgggagaccttttaaataatacagaagtttaaaacagcaaaatttacttgacactgcaaattttaaaaactagnttatatccttttactaaatatttcccaanggaacagcgtnacattcacaagttcactggatnacttcagatttggatgagataaagggg

SEQ ID NO: 18016 - DNA, 198 bp, Homo sapiens
ggtgaaaccccctctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcgaaaaaaaaaaaaaa

SEQ ID NO: 18017 - DNA, 479 bp, Homo sapiens
  misc_feature 26, 38, 55, 57, 62, 90, 470: n = A,T,C or G
ggacttaagtagccaaaggatctttnccctgacacaantctgctagacctgcaantnaacanaataaccgaaatcaaagatggagacttnaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcataggaactgggcaccaatccgctgaagagctcaggaattgaaaatggggcttccagggaatgaagaagctctcctacatccgcattgctgataccaatatcaccagcattcctcaaggcttcctccttcccttacggaattacatctngaggcaaca

SEQ ID NO: 18018 - DNA, 239 bp, Homo sapiens
  misc_feature 76, 195: n = A,T,C or G
caaggaaggaagttttgagattgacattccagtccccaaatacttatcttctgtgagctcacaagaaactcagggnaggccccttagctcctatgactggaaccattgaaaaggtgtttgtcaaagctggagacaaagtgaaagcgggagattccctcatggttatgatcgccatgaagatggagcataccatanagtctccaaaggatggcacagtaaagaaagtgttctacagagaa

SEQ ID NO: 18019 - DNA, 324 bp, Homo sapiens
  misc_feature 8, 37, 158: n = A,T,C or G
ctgctggnagaaactggcaaggagaagctcccgcggnactacaagaacatcggtctgggcttcaagacacccaaggaggctattgagggcacctacattgacaagaaatgccccttcactggtaatgtgtccattcgagggcggatcctctctggcgnggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtacagtgggcgagtgcc

SEQ ID NO: 18020 - DNA, 300 bp, Homo sapiens
  misc_feature 25, 105, 267: n = A,T,C or G
gtctcaatttaatttgttgtaaggnggggcggggggaattgcttggtttcaccatttcagatctgtgttgctaagagtattaacgttttaattaagcaaagaaangatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagnttgaccaattttttttaaatatacttcctttta

SEQ ID NO: 18021 - DNA, 361 bp, Homo sapiens
gctcaaaaaaagaagagtcggggacctcctagccagttacattccagaggatgaggcgctgatgcttcgggatggacgctttgcttgtgccatctgcccccatcgaccggtactggacaccctgccatgctgactgcccaccgtgcaggcaagaaacatctgtccagcttgcagcttttctatggcaagaagcagcccgggaaaggaaagaaagcagaatccaaaacatcagaatgaattgggaagggaagaaaccaaagctgaggctcctctgctaactcagacacgacttatcacccagagtgctctgacagagctccccactataacagttgctgccgccggaagtacagaccagaag

SEQ ID NO: 18022 - DNA, 289 bp, Homo sapiens
  misc_feature 37, 147, 177, 193, 195, 218, 219, 268: n = A,T,C or G
aagagatgaaaaacacccacctgaaaatatcattgangggaatccagaaacgttttggaccaccacaggaatgtttccccaggaattcattatttgtttccacaaacatgtaaggattgaaaggcttgtaatccaaagttactttgnacagaccttgaagattgaaaaaagcacgtntaaagagccagttgantntgagcaatggattgaaaaagatnnggtacacacagaggggcagtttcaaaatgaagaaattgtggcacatganggctccgctacttactttgag

SEQ ID NO: 18023 - DNA, 289 bp, Homo sapiens
gacttgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatat

SEQ ID NO: 18024 - DNA, 277 bp, Homo sapiens
  misc_feature 42: n = A,T,C or G
caggattatccatttttaggctgtgtagtttaggatgacgtntcattgaaagaataaattactgaaataatgaagacaaaagaaatttactgaagagcctctaacgagagcagtcattttatcctaggtgacagttatgtccctaaataagtttcgtaatttctgtatgtgaagcccatcactggaagagtggtataccagggctcaaatactggtggagactttacgtaatgatctgtttcattttcaagatgagagtttatcaccttctcttaac

SEQ ID NO: 18025 - DNA, 296 bp, Homo sapiens
tcgcgctactttttcttttttggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactgggctttctatctcttgtactacactgaattcacccccactgaaaaagatgagtatgcctgccgtgtgaccatgtgactttgcac

SEQ ID NO: 18026 - DNA, 300 bp, Homo sapiens
  misc_feature 29, 93, 113, 171, 178, 224, 284, 298: n = A,T,C or G
gtaagagcaacgtgctttgggagcagagnggagggagaaagcagcatcttgcctggatgagccaggggacacagaagagaagcccactatctnatttaatctttacaactctnttgcaaggttccctggttgtgaaaatacatgagataaatcatgaaggccactatcatnctccttntgcttgcacaagtttcctgggctggaccgtttcaacagagaggctnatttgactttatgctagaagttcctgatgaccgcgacttcgagccctccctagggccagnggcccgttccgttnca

SEQ ID NO: 18027 - DNA, 400 bp, Homo sapiens
tgccatcctggccgccttagcggaagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctt

SEQ ID NO: 18028 - DNA, 450 bp, Homo sapiens
  misc_feature 350, 397, 414, 423: n = A,T,C or G
gagtgatgttagcatgacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggttgggatcaataggaaagcatatgcagccaaccaagatgcaaatgttttgaaatgatatgaccaaaattttaagtaggaaagcacccaaacacttctgctttcacttaagtggctggcccgcaatactgnaggaacaagcatgatcttggtactgggatattttaaatatccacagnactcactttttccaaangatcctagnaattgcctagaaaaaccttcccttacc

SEQ ID NO: 18029 - DNA, 151 bp, Homo sapiens
  misc_feature 5, 74: n = A,T,C or G
gaaantagccaggcatcttgtaatcccacctactcaggagcctgaggcaggagaatcgcttgaacctgggaggnggaggttgcagtgaaccaagatcaagccactgcactccagcctgggtgacaagagcgaaactccatgtcaaaaaaaa

SEQ ID NO: 18030 - DNA, 340 bp, Homo sapiens
  misc_feature 148, 180, 193, 234, 236, 247, 300, 307: n = A,T,C or G
agtgctcaataggtgtagtagcaatgatattacctctgaaaccaaatactcttttatccttgattccactatgggaccttataactagtccatgaaaccaagctcagaaaagctttaactcttatatttgtgtatatgtatgctgctnctgaaaatataatttttctaagttgttgtaangactttaatttgnaatcagctaaggcttaagatttcatttgttctaagttctgntntcatccctctntttctttatattagtcagacctagagccagagaagctctcacagggagtcaantggtagngaacatggactgcatcaccagttttctaccttc

SEQ ID NO: 18031 - DNA, 430 bp, Homo sapiens
  misc_feature 349, 354, 420: n = A,T,C or G
ggctaatcacaggccggggacagtggctcctgcccgtaatcccagaactttgggaggccagggcgggtggatcacttgaggtcaggagttggagaccagcctggccaacatggtcagatcctgactctactaaaaatacaaaaattagccaggtgtgtggtggcatgttcctgtggtcccagctactggggaggctgaggcaagagaatcgcttgatcccaggaggtggaggttgcagtaagccgaggtcacacaccactgcactccagcatggcgacagaaagagactctgcctcatatattaattaattaataaattaataaaaagctaatcgcagtattgggatgncgggnaggtatggcacattgactaggggacagactagaagctgagaaacccagaccacataagtgctgctngaaaacaatc

SEQ ID NO: 18032 - DNA, 310 bp, Homo sapiens
ataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagtgcatctgaatataacatgatgcattcaatgaagtcatatccatgaattcactc

SEQ ID NO: 18033 - DNA, 300 bp, Homo sapiens
  misc_feature 71: n = A,T,C or G
caaggcttgtttataaaatacttgagaattacattaatgtggaatcaacagatgcagaagaatataacatnacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataa

SEQ ID NO: 18034 - DNA, 352 bp, Homo sapiens
gaggaaaccgcagataagtttttttctctttgaaagatagagattaatacaactacttaaaaaatatagtcaataggttactaagatattgcttagccgttaagtttttaacgtaattttaatagcttaagattttaagagaaaatatgaagactcagaagagtagcatgaggaaggaaaagataaaaggttctaaaacatgacggaggttgagatgaagcttcttcatggagtaaaaaatgtatttaaaagaaaattgagagaaaggactacagagccccggaattaatacccaatagaagggcaatgcttttagattaaaatgaagggtgacttaaacagcttaaagtta

SEQ ID NO: 18035 - DNA, 129 bp, Homo sapiens
  misc_feature 36: n = A,T,C or G
gatgatgacttttaccaccagctccttcgagaactnatagaacggaagaccagctccttggatcccaacgatcaggtggccatgggaaggcagtggcttgcaatccagaagttacgaagcaaaatccac

SEQ ID NO: 18036 - DNA, 316 bp, Homo sapiens
  misc_feature 24, 25, 32, 43, 198, 245: n = A,T,C or G
ggctatccagcgtactccaaaganncaggttnactcacgtcanccagcagagaatggaaagtcaaatttcctgaattgctatgtgtctgggcttcatccatccgacattgaagttgacttactgaagaatggagagagaattgaaaaagtggagcatacagacttgcttgcagcaaggactggctgactatctcttgnactacactgaattcacccccactgaaaaagatgagtatgcctgccgngtgaaccatgtgactttgcacagcccaagatagttaagtgggatcgagacatgtaagcagcatcatggagg

SEQ ID NO: 18037 - DNA, 281 bp, Homo sapiens
  misc_feature 34, 36, 78: n = A,T,C or G
gacttaatgcctttggaaccttccaagatgccananaactctagatagaaggctgggcctccatgatgtcaggaatgnagcattcttatttccccatagataaacccatttgttccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagccca

SEQ ID NO: 18038 - DNA, 199 bp, Homo sapiens
gcacatagtttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgactttt

SEQ ID NO: 18039 - DNA, 204 bp, Homo sapiens
  misc_feature 116, 119, 174: n = A,T,C or G
aaacatgctccgcagatcatcggtcaggccaagaagcatccgagcttgatccccctctttgtatttattggaactggagctactggagcaacactgtatctcttgcgtctggcatngancaatccagatgtttgttgggacagaaataacccagagccctggaacaaactgggncccaatgatcaatacaagttctactcagtg

SEQ ID NO: 18040 - DNA, 306 bp, Homo sapiens
  misc_feature 226, 229, 251, 277, 278, 288: n = A,T,C or G
acagcagtagttgttactttgatgacatagagcagaataggaatggtccaaaagagttgtgtcctcaaagcaactgatgaattgagcacattttacacattttcagtgtcattaatcactctccctctttcttttctaacactactcagttgttaacctggcttcatcttggaaaaatgggaggaaatgcgagtatattattggaccaagaagtatatcagtatgnttntagcttttcctctccaggcagnttaatttttgaagctaagctcttgtnntcatgtagantgcaccatgcctgggttt

SEQ ID NO: 18041 - DNA, 310 bp, Homo sapiens
  misc_feature 37: n = A,T,C or G
aaagagctttactcacattctggagataagcaaaacngaaaaatatgcagtcctcagcaatgtaactgcaaactcgccaatgtaatcaatgatgttttgattcacatctgcaggtaacagtacctaatgattagaatgatttcagccaaaagtgtatgagcatttatgtctaaagtaacacccagtttagaggtgtgctttgtaatccctgatggagtaatacaaaaccttcagtagagtcattaaggaatgacaccaattattgtaaaatatctcaggaaaatgaatgaggacaaactttatttacaca

SEQ ID NO: 18042 - DNA, 420 bp, Homo sapiens
  misc_feature 31, 32, 34, 151, 185, 210, 216, 250, 259, 270, 272, 277,279, 288, 295, 328, 378: n = A,T,C or G
gcattaagagatattagatatttcttaatgnncncatagtgctcaataggtgtagtagcaatgatattacctctgaaaccaaatactcttttatccttgattccactatgggaccttataactagtccatgaaaccaagctcagaaaagcnttaactcttatatttgtgtatatgtatgctgctnctgaaaatataatttttctaagtgntgtaangactttaatttgtaatcagctaaggcttaagatntcatttgtnctaagttctgntntcatncntctgtttcnttatatnagtcagacctagagccagagaagctctcacagngagtcaagtggtagggaaccatggactgcatcaccagttttcttacctcngtggcagcggatattctgtactcagactgcaaaaccagaact

SEQ ID NO: 18043 - DNA, 157 bp, Homo sapiens
tgttgttcagtaaaaatggtagagaattccaatggccctagccacaagggaccagttccactgagaagtgaacagtgggaactcaaaatttcagaaacattgggggaagggaaaattggctttctcttaattggcagatgttccagtggggcggggg

SEQ ID NO: 18044 - DNA, 249 bp, Homo sapiens
  misc_feature 216, 231, 234: n = A,T,C or G
atcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaggtattttgaataccattaaaactgcttttttttttccagcangtatccaaccaactnggntctgcttcaataaat

SEQ ID NO: 18045 - DNA, 337 bp, Homo sapiens
  misc_feature 268, 320: n = A,T,C or G
ggaggaattgaagatttttctaatgaaaagaaaaagggtcacatgaacagatgttgcagtgtacctgtgccagggatttcatgtgtacactttataggagaataagcaagagcttaggtaagttatagtccttaccattgggtctaaggcagtttccaggaaagcatggcaactcgttcagctatgtaagttgaactctgtaccacttgggagggaacattcccctagatgacaatgtcagtggcactcgaagttgtgcagtgcacanttcttatctaccaacatatacagcagtccttctgggaaggaaatttggcagnaaagggaactcacagtg

SEQ ID NO: 18046 - DNA, 362 bp, Homo sapiens
  misc_feature 30, 42, 47, 56: n = A,T,C or G
caaccagcttgtagattttcagtggaaacngggtatggctgngagcncagacactngcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacggg

SEQ ID NO: 18047 - DNA, 170 bp, Homo sapiens
  misc_feature 144: n = A,T,C or G
tgtcatatcctccctactatgcctagaaggaataatactatcgctggcattatagctactctcataaccctcaacacccactccctcttagccaatattgtgcctattgccatactagtctttgccgcctgcgaagcaagcggngggcctagccctactagtctcattct

SEQ ID NO: 18048 - DNA, 268 bp, Homo sapiens
  misc_feature 29, 30: n = A,T,C or G
agtggctcccagctttgccgcacctcacnntcacctggggagctttgaaaattcccagtgcctgggctgcacaccctaccagtgaaatcagaatatctcagggtgggagtcaggcagcagtcgttttggttttgttttttcttttaaagaacccaggtgatgtagtcccagcactttgggaggctgaggcaggcggatcacaaggtcagcagttcgagaccagcctggcaatatggcgaaaccccgtctctactaaaaaaaaaaaaaa

SEQ ID NO: 18049 - DNA, 295 bp, Homo sapiens
tcgacagaaaaaacattctaattggcaccacgtcacacttattctaaaattgaccacataattggaagtaaaacactcctcagcaaatgtcaaagaaaagaaatcacaacaaactgtctctcagaccacagtgcgatcaaattggaggtcaggattaagaaactcactcaaaaccacacaactacatggaaacttaacaacctgctcctgaatgactgctgggtaaataacaaaatgaaggcagaaattaagatgttctttgaaaccaatgagaaaaaagacacaacataccaga

SEQ ID NO: 18050 - DNA, 110 bp, Homo sapiens
ccctgtaggcgtgctagcaattccagggtggtccgggtttggcagatttgatttttaaaaaacgtattatctttaataaaatgttattatgtcaaccagtgaggctgcct

SEQ ID NO: 18051 - DNA, 300 bp, Homo sapiens
acctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgtctctttggcaacttatccataatttgggatcaaatgttaaaaccagaa

SEQ ID NO: 18052 - DNA, 161 bp, Homo sapiens
aaagaagttattgagtcacggattattgtgcatcaagcaattgttaatatgacctggcctatggggtagaacttaggaaaaataaagttggttcttattcaatattttactttgcaaaattctagtaaaagagagtatataataaaatcataataaaaggt

SEQ ID NO: 18053 - DNA, 224 bp, Homo sapiens
gaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggcaaagaccgcaaaaagatcctcgaacggaaagccaaatctcgccaagta

SEQ ID NO: 18054 - DNA, 340 bp, Homo sapiens
ctgctttcctgagtttttaatggaaacaattatatcatataagaaactatctcacttgtttctattccctgcatcatatatggaaaaatacagcagttagttgaattgtctgctagaaagtgcctctaaaggaaaatataagtggaagaaaattcgcaagtgtatacattaaggttgaagtgaaaaggggaagggagaaggaggaggatgctgaggcacattccaatttttgaagattatttgctaatgtcatgaaggaagttacagtcgcctctgaaacgtaggtacaaattttttgaggtcattaaaccttgattataaaatcaccatgattagagat

SEQ ID NO: 18055 - DNA, 186 bp, Homo sapiens
agaaattgaaacctggcgcaatagatatagtgaccgcaagggaaagatgaaaaattataaccaagcataatatagcaaggactaacccctataccttctgcataatgaattaactagaaataactttgcaaggagagccaaagctaagacccccgaaaccagacgagctaccgaaaaaaaaaaaaa

SEQ ID NO: 18056 - DNA, 301 bp, Homo sapiens
tatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagtcctgatgaccgcgacttcgagccctcctaggccagggggcccttccggtgcaatgcatcttcgagtggtcagggtctgaattgggctgg

SEQ ID NO: 18057 - DNA, 364 bp, Homo sapiens
agccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggcctgatcaagaatttggtgtggacgttgccctgtttgctttttataaaccaaactctatctgaaatcccaacaaaaaaaatttaactccatatg

SEQ ID NO: 18058 - DNA, 420 bp, Homo sapiens
  misc_feature 34, 233, 254, 257, 293, 310, 319, 334, 344, 362, 381: n = A,T,C or G
ataagtgggtggagaataacacaaacaatctggngaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagngatggctccaatgaagctggnggnatctaccaagtcctagaaataccatatgaaggagangaaataagcatgatgcngggggctgnccagacaggaaggtncctcttggcnactctggagccattaagncaaaagcacaagctgggtnggaagaaaggggccaaacctctggggaaagaagccaaaa

SEQ ID NO: 18059 - DNA, 470 bp, Homo sapiens
ttcagcaacccggtccagtactgggagatctgccatccaccttcagatgtgctacgtgcgcgctgcattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgcattttcaagaatcatcttttgaagctttctgtggatgttaacctgagcctactaggagatattcttattcactaaatggaaaatttggaggaaatatatatgcaatatttaggaaaagctttctttttaattccaggaaaaaataaaaagagatgagcttctgtaatcatgggcagtagctcatttgagataag

SEQ ID NO: 18060 - DNA, 387 bp, Homo sapiens
acttgagaaaatccagcatccttattttattaagaccctcagcaaaatcagcatagaagggacatacattaaggtaataaaagccatctatgacaaacccacagccagcattatactgaacagggaaaagttgaaagcattcctcctgaaaactggaagaagacaagattgcccactttctccacttctattcaacatggtactggaagttctagccagagcaatcagacgagagaaagaaatcaagggcatccaaagtggtaaagaagaagtctgcctattgctgtttcccaatgatatgattgtatacctagaaaaccctaaagactcatccaaaaagcttctagaactggtaaatgcattcagcaaagtttcagggtacagagt

SEQ ID NO: 18061 - DNA, 287 bp, Homo sapiens
ctttagcagcttacgattttgagagactttctgcgacttagaagagtagcatgaggaaggaaaagatgaaaggttctaaaacatgacggaggttgagatgaagcttcttcatggagtaaaaaatgtatttaaaagaaaattgagagaaaggactacagagccccgaattaataccaatagaagggcaatgcttttaggattaaaatgaaggtgacttaaacagcttaaaggttaagtttaaaaggtgtaggtgattaaaataattggaggcgactttttaaaaggag

SEQ ID NO: 18062 - DNA, 300 bp, Homo sapiens
ttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgtatttaaaagaaaattgagagaaaggactacagagccccgaattataccaatagaaggcaatgcttttagattaaaatgaaggggact

SEQ ID NO: 18063 - DNA, 363 bp, Homo sapiens
tcccagtgctggtattacaggcatgagccaccgtgcccagtcctaaaagggctttttgttttctattacaaaaatccaaatgtttgactaggaaaaaggagctgatttttaaaatattatataaaccacaggttgaagcagatgcatgttgcaattagtttgttttttcagtcagtaattataatagctataatttagtgacacctactttatgatatgtactggctgggtattttaatattagctggcttctttaaatctacaaagtaatttctaaaggttattgtcactatctttattaagttaagtagaatttacttaaaggcacaaagtagaattatttcttaggggcacagaaatagg

SEQ ID NO: 18064 - DNA, 170 bp, Homo sapiens
acacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgt

SEQ ID NO: 18065 - DNA, 470 bp, Homo sapiens
cggcggaggggcttgtgctgagggggcagtttgtggtcggggacgcggcggacgagatgttttgggtttgatagatagagattagtgcaactacttaaaaaatatagcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatggatttaaaagaaaatggagagaaaggacttccgagccccgaattaataccaatagaagggcaatggtttagataaaatgaagggcttaacagttaaagttagttaaaagtggaggtgataaaatattggaggcgactttaaaaagagataaaccgaaggggttaaagacctggaatccatgcgcggggagaa

SEQ ID NO: 18066 - DNA, 170 bp, Homo sapiens
agcgcaggggcttctgctgagggggcagtttggagcttgaggaaaccgcagacaagttttttcctctttgaaagatagagattaatacacctacttaacacatatagtcagtaggttactaagataacgcttaacatctaagttttgatcatttctttagcaagctttac

SEQ ID NO: 18067 - DNA, 300 bp, Homo sapiens
  misc_feature 31: n = A,T,C or G
gaagtcctgacccctaaaagatacccccagnagaagtcctaaccccaaaaagataagttgaaatacctcagaatgtgaccttatttagaaagagggtgtttggaggtgtaatcgggttaagaggaggtcttagtggagtgaactgatctcaccatagtccttataagaaggaacatgtgaagagagagacacagggagatggccacatgacctcagaggcagggacaggggcagtgcggctgcaagccaaggattgctgaccacaccagaagctaagagaagagcctgaagcagattttc

SEQ ID NO: 18068 - DNA, 322 bp, Homo sapiens
ctgaagctagcactatgttcacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgtaaaaatgtgacagttgtcaaaaaatgcactaaaatgtaaatggagattgacaagtcactttccagcttataggca

SEQ ID NO: 18069 - DNA, 502 bp, Homo sapiens
  misc_feature 69, 264, 329, 387, 388, 411, 425, 457, 498: n = A,T,C or G
cactatataactgataaaagcacttgggctttgattatcagatactgtctctaaaattattttaaagantaatatttgttcaagtagagaatgaagataaaaaaggaatttgaggccaggtatggggtgtctcatgcctataattccagcactttgggaggccaaggcaggcagatcactttgaggtcaggagtttgagaccagcctgccaacatggagaacccccccgtctctacaaaaaatacaaaattagcagggtgtggnggcgcacacctgtagtcccttactccctggggctgaggcattatcccttgacctgggaggcaganctaaagtgagccgagatcgcgccactgcactccagcctgggtgacacagcgagctctnnctcaaacaaacaggaatttgagnaaattttaaatagnatatactacacaaatttccaaactcataattngctaggagggctaactaaaatttaccccagggaaaacaggncacc

SEQ ID NO: 18070 - DNA, 390 bp, Homo sapiens
tttcatggcaaattttattttaactgtttctatggttgctggaaatgccgaggcttaagttactaaaaccatgttttaagtagctacaggagctatagatttgaatctaatgttgcattagtcttttcagttatcttctacctcctgtattttctactgtaataatgtaatttaaggccttccacaatgaacagtcactttattccctgggttttctataaacagtttaaggatatgatttggtaaaaaataattggtataaaaatctgttgcaaataaactggaaaagatccagagctcaaaagcatgatttgggagataatatggatgcccggagcccggccatcaatgaaaaccatatgtaataatcgaatcatttacatgaatctt

SEQ ID NO: 18071 - DNA, 283 bp, Homo sapiens
gcatatggattatataaactgaagagcaggggaaatactaaaatgtccattcatctgatccacatgcgtgaggcaagcccaaggctttgttgtaggagcaatgactgttggtatgggctattccatgtatcgggaattctgggcaaaacctaagccttagaagaagagatgctgctttggcttggtggaggagcttgctttagttagatgcttattattaaaggtacctattattgtggaaataaactaatttgtatgggttagatggtaacatgcattttga

SEQ ID NO: 18072 - DNA, 220 bp, Homo sapiens
  misc_feature 28, 30, 43, 51, 68, 98, 168, 172, 182, 190: n = A,T,C or G
aggaaacatatattaactttggattatntngaagttaggaganaattttgngaagtcttggtcctgtnattttattatgttgtaaaatgaaagttggnggaataacagatgaaaatagttatcaggcccacgcctgtaattccagcactttgggaggctgaggcaggnagancacctgaggncaggagtncgagaccagcctgaccaacatggggaaact

SEQ ID NO: 18073 - DNA, 300 bp, Homo sapiens
cagttgaatgaacaaattatttcagtgtgacagccatgactcaagttccaattagtctgaaaagggtactttggaattgcccatattaatcagagatggcaaaagaaaaagttctcatattaccaggttgattttgtgtctcatttcaaattttaatttaaaattatgggtttcatttttgtttaccttaaagtgatgcttaaaagtggcatgtaattaggacacttaggttgtggaagcattttcgcatttggataaaagaatttgtgataaatatatccagggcccaccaaagaaaca

SEQ ID NO: 18074 - DNA, 315 bp, Homo sapiens
atgcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggttttaa

SEQ ID NO: 18075 - DNA, 490 bp, Homo sapiens
  misc_feature 28, 328, 357, 363, 366, 397, 430, 452, 459, 474, 483: n = A,T,C or G
accactcctaggtttattgtttcgatanggggacttacaggattagtatatagttgcactcctgactaagatttattatagcaaaagaatacacagcaagattagcaaaggaaaaaggtgcatgggaccaagtctggaggaaatgagtctcgaactcctgacctcaggtgatctgccagccttggctcccaaagtgctgggattacaggcatgtgccactgcacccagcctgaaagtattacttttaagaattgttattatactttacttgaaagaaataaccactgctatagtattatatcataccaaagcatatattttataattngggctacctagaattattatttttttttnggaaangangttatatgtaggtataaatcacaaatgactnggaaataaaggccatatgactcaaaaccaaccnggacctagcttagataagaccngcggttnaaacaggaacctctnggtggaganaaagaaa

SEQ ID NO: 18076 - DNA, 199 bp, Homo sapiens
ggttgctaaggcaagcattttattgactgctagttttggagcttgtgatgataagctgaaccggaggacggccagtaagctacccttttaccatcattggacaagtagcatcccgtactatacttcacaacaatcctaatcctaataccaactatctccctaattgaaaacaaaatactcaaatgggcctaaaaaaaaa

SEQ ID NO: 18077 - DNA, 160 bp, Homo sapiens
taggggacattttgcaacaagcacactgatctgacaagaatttccagctgacagagagggaagacaccgctattccatgtataaggaaattctggccttaacctagccttggacgaagagatctgtattgggcgagttgtaggagcgcgcccaattagga

SEQ ID NO: 18078 - DNA, 303 bp, Homo sapiens
aataaaaataaaaaaagaaccaaaagtagaactaccatttgattcagcattctcactactgggtaactacccagaggaaaagaagtcattatacggaaaagatacttggacacacatttatagcagcataattcacaattcaaaaaatatggaaccagcccaaatggccatcaagtcaatgagtggataaagaaactgtgagatagatataggatatggatatatgatggaatcctactcagccataaaaaggaatgaatgaatagcatttgcagcacctggatggagttggagagtattatt

SEQ ID NO: 18079 - DNA, 480 bp, Homo sapiens
  misc_feature 26, 298, 318, 393, 399, 441, 455, 466, 468, 474: n = A,T,C or G
tgcatgcgtggcattccttcgacttntctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggnggcctgatcaagaatttggnggggacgttgccctgtttgctttttataaaccaactcttctgaaatccaacaaaaaaaattaactccatatgggncctctngtctaatctggcaaccaggcaaggaccgacaaaatccagttntttatttccaaaangttgggaaccngntaattnggcaaa

SEQ ID NO: 18080 - DNA, 254 bp, Homo sapiens
atcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtaaggaaaggtaaaaa

SEQ ID NO: 18081 - DNA, 301 bp, Homo sapiens
ctggtcaggatgatcacggacgtgcagctggccatcttcgccaacatgctgggcgtgtcgctcttcttgcttgtcgttctccatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaaca

SEQ ID NO: 18082 - DNA, 301 bp, Homo sapiens
catgtttgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgccctttcacatcaaagactccgacacgaaggccggcctgcctt

SEQ ID NO: 18083 - DNA, 510 bp, Homo sapiens
  misc_feature 37, 357, 441, 469, 489, 500, 504: n = A,T,C or G
atgttgtgatcttcagctttgaacccatgaacttgtntgtggaaaacacgtttattatttaaaaatttatatgaaagtacagaggatttttaaaaatcctctcatatattaacactcacagatatccattgacaatattccatgaatgcaattctagaatacaaatatctttacaaaaataggattaatattttatgaatttaattttctcaaatagcaggctgtgttaatgaaatatattaaacataatttgacttataacttcaagtaaatgttttttcacagtaagatatactattccttgaaatattcctccaaaattaagaaaaacaattatgaaaaacgtgacaatatggngtcagtactttactgggaaacaatatataaacattaaaattgatcaggaatgggggctcacgcctgtaatcccagcacttttanggagggccaagggagggacaaattttanggaagggatcaggttggaangcccagggaanttcnaaggaa

SEQ ID NO: 18084 - DNA, 300 bp, Homo sapiens
  misc_feature 64, 224, 278: n = A,T,C or G
ttaaacatagaggtaccaccacaagggatgccctactctctcgcagctcttgaaagcatctgtntgagggaaaggtctctgggcaagcaagtggttatttggattgcttgcttccctttttccacctgggacattgtaatcataaaataacagtaaattccaaacctcaaaaactattatggctgagcacagctgaaatctagcagagttaactcttctgcctncatgtctgcacttataattcaaggtctgctgtggcttcagaacatgagcagaanatcgtttatgctagtattgcat

SEQ ID NO: 18085 - DNA, 143 bp, Homo sapiens
tctatatagctgatcagtttttccacctggggcgtgggtttctactctgatatgactggttttcggacagtttatttgttgagagtgtgaccgaaagtacatgaagcacctttataggtggaaataaagcgacattttttcta

SEQ ID NO: 18086 - DNA, 142 bp, Homo sapiens
tatcctcactttctatctattgcacctaaggaatactacacagcatgtaaaagtcaatctgcatgtgcttctttgattacaaggcccaagggatttaaatataacaaaatgtgtaatttgtgactctaataaaaaaaaaaaa

SEQ ID NO: 18087 - DNA, 152 bp, Homo sapiens
catattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcag

SEQ ID NO: 18088 - DNA, 102 bp, Homo sapiens
  misc_feature 34: n = A,T,C or G
tacctgtaatatcaacactttgggaagctgaggngggaggagagcttgaggccaagagtttgagaccagcctgggcagcatagcaagaccctgtctctacga

SEQ ID NO: 18089 - DNA, 205 bp, Homo sapiens
ggacaacacggagaaacccgaactgtactagaaatacaaaaattagccaggcatgggggtgcctgcctttaatcccagcttctcaggaggctgaagcaggagaattgcttgaacctgggaggcggaggttgcggtgagccaagatcatgccactgcattccagcatgggcaacacagtgagactctgctcaaaaaacaaaacggc

SEQ ID NO: 18090 - DNA, 401 bp, Homo sapiens
tgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgcccctacacagtttcccattatgccgttggagatgagtgggaacgaatgtctgaatcaggctttaaactgttgtgccagtgcttaggctttg

SEQ ID NO: 18091 - DNA, 149 bp, Homo sapiens
caaacttagaagaaaattggaagatagaaacaagatagaaaatgaaaatattgtcaagagtttcagatagaaaatgaaaaacaagctaagacaagtattggagaaatatagaagatagaaaaatataaagcttaaaaaaaaaaaaaaaa

SEQ ID NO: 18092 - DNA, 300 bp, Homo sapiens
  misc_feature 32, 271, 288, 295: n = A,T,C or G
accccaccccaaaattagccagtaatcctgtnggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctacctctcttgtaattnggatctcttcttaatgnacatagngctaa

SEQ ID NO: 18093 - DNA, 300 bp, Homo sapiens
ttcctggggcaggaggtcgcttagccctgaaaacaatcaggtattgaccaagaagaaattacaggacttaggaagagaagtggatcctaatgagcagctggatgaagatgtggaggagatgctgctgcagattgctgatgattttatcgagagtgtggagacagcagcctgtcaagcttgcgcggcatcgcaagctagcaccctggaggggaaagatgccagctgcatttaagagcgcagtggacatgtggatccaggattgggctctgaagaaatccgacctacaaaaaagcttgccca

SEQ ID NO: 18094 - DNA, 440 bp, Homo sapiens
tgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagcatgagtttatgagctgatttggcaccttcctctgcctttgtcactgtgagtctgatgtcttaggacttagtcttagaagctcacgccttagtttgaaaca

SEQ ID NO: 18095 - DNA, 310 bp, Homo sapiens
ccttacttcctaccaattgtttttacctattttattaaatttttttatgtttaacttacatacttccaaaattacttgaagcagtttacaaataaaatgtttaagaaagaaagaggagtagggctgggcctggtggctcatgcctgtaatcccagcactttgggaggccgaggtggacagatcactagaggtcaggagttcaagaccagcctgccaacatagtgaaaccccatctctactaaaaatacaaaaattagctggcacagtggcaggtgcctgtgatcccagctacttgggaggctgaggtggg

SEQ ID NO: 18096 - DNA, 269 bp, Homo sapiens
ggctattctgaggcgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcg

SEQ ID NO: 18097 - DNA, 261 bp, Homo sapiens
agcttatggtagttcataaatctccatgttctattatctttcatctgccaataaagttcattttcaataatgtccaccattgctgtgcccagaataaccaccggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgag

SEQ ID NO: 18098 - DNA, 480 bp, Homo sapiens
taccttccgacccatactcttgcatgttgactgtaacaaactgaatattcacagtaaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagtctacacattacattgaagttaaacacaaaattatcagggttttagaaacatgagccggactgtgtaagtaaaagacaacattatttccaccataaaggatgtattggaatcaagtgctctgtggacagaatacatacttattccatttttaagcattgctctgtttccctacctagaaggcagaggttttcaggtatctcccatttggcaaagttgacctcaagatacattttcattaagcttgagactaagaacacaa

SEQ ID NO: 18099 - DNA, 382 bp, Homo sapiens
tgcaggcataaaattgcacatgtgtctccgaggattttgctgctcagattctggtatccagatgttgggattttaaccaaggctgtaaatagcagagaaagtttttttattattttaaagatcaaattccaaaattctggtgtgttttgcttaattgagagtacatgttacttctgagaatgtactttaaaaagtaaacaaatttaactgaagcatggctattagttagtgattctttgtagattttctggaaagtcttgtttgtttgtattaaacattaactctgctgtatgctgtaaatacactgctaagatcaatattgaaaaacgaacaataataccaattcatatggaccttcaaattagtcttataaaattttatg

SEQ ID NO: 18100 - DNA, 499 bp, Homo sapiens
actattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgtccagccaatggccagactccaatccagagaaccatcaagccagatgtcagaagctacaccatcacaggtcaggggaactcattgactaaccacatttgttaacaaatacccac

SEQ ID NO: 18101 - DNA, 301 bp, Homo sapiens
  misc_feature 31, 32: n = A,T,C or G
actgacctgcaggacgaaaccatgaagagcnngatccttcttgccatcctggccgcttagcggtagtaactttgtgttatgaatcacatgaaagcatggaatcttatgaacttaatcccttcattaacaggagaaatgcaaataccttcatatcccctcagcagagatggagagctaaagccaagagaggatccgagaacgctctaagcctgtccacgagctcaatagggaagcctgtgatgactacagactttgcgaacgctacgccatggtttatggatacaatgctgctataatcgct

SEQ ID NO: 18102 - DNA, 380 bp, Homo sapiens
  misc_feature 370: n = A,T,C or G
acatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatctngttaatgtca

SEQ ID NO: 18103 - DNA, 500 bp, Homo sapiens
ctgggggtgagttaggtttagtttagcgagatgatctcttttacacatgtctcatctccctcccagggcaagtgggctaaccccagcaatgttgtcctcatgacaacctcagaggtaaaagggggcaaatagaaacatacaaggcctcttaaggtctaggcttgaaactggcacatgatcacttctactttattcttttgctaaaacaagttatatagctgaacccaaattgagtgatggagaaatactcttggaacttttactaggagaaactgtaaagcatatggcagaaaatattgacctcggagtgtttttggaggatataaattggtatttaaatacgttaaaatggggattcaattaaaaattaatggtggtggcccgggtgcggtggttaatgcctgtaatcccaacattttgggaggctgagtgggtggacaaggaggcaaggagatcaagaccattctggccaacatggggaaactcggctctacaaaaaa

SEQ ID NO: 18104 - DNA, 383 bp, Homo sapiens
tgagggacctcataatccaagggctcagaaacagatcttatgagggtctagaatcaggaactaaacatcagccaggaactaaggccaccattctcccaatctctctggggctcctcagcccgatccctctgtagctctctttaattcaagatgactatagataactctttacgtagagactggatttccctactgcccattacacaagcacaactctcaagtgtgctttctcatgaatgccagcttcaagcagtatattaatttttaatgacctgagctgcttagctaataagctgtgatcaatggaatagaccaggtggtgcatatatagttgccaggatcctatacctatgggtgggaagagggaagaataatcagtgaaa

SEQ ID NO: 18105 - DNA, 180 bp, Homo sapiens
ttccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaa

SEQ ID NO: 18106 - DNA, 300 bp, Homo sapiens
  misc_feature 24, 29: n = A,T,C or G
ttgactagggagatgtagttaagntgtcnggtgtcactaagggctcacatgatgtttgtaaccatgtatttaatgtgagaccagctagcgtgatcgagagctttccttcagctgctcaggtgcaagtgtggcagagaagaggaataacacaataaaataaaaccacagataaattataaattaataaagagaagtagagattggctttaatcaggattaaggttttgccacgctagtatgacagaggaagatggggcaagggaatgattataatgatggccatggaatctagtttcatta

SEQ ID NO: 18107 - DNA, 337 bp, Homo sapiens
ttttagtcttttcaatatttctaggctacatggttcttctgcaagttttttcaaattgttgcaaatatccaaaaatttttccaatatgtttgttgaaaaaaatctacagataggtggacctgtgcggttcaaacctgtgttgttaaagggtcaaatgtagtttcttagctatagtaccaaaaacacaagcaaggagagacaaaaaaacctgagtatcaaaaatataaacatttgtaccacagaggacatcatcaagaaaatgaaaagacaaccaaagatgggaaaaaattttataaattacacctggtaaggtacttgtatgtaaaatatacaaaga

SEQ ID NO: 18108 - DNA, 310 bp, Homo sapiens
acacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggcataattatggtgggtgattattttttatactgtatgtgccaaagctttactactgtggaaagacaactgttttaataaaagatttacattcca

SEQ ID NO: 18109 - DNA, 342 bp, Homo sapiens
attggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccggccaggcacagtggccacacctgtaatctcagtagccatgaccataccaatgcactccagcctgtgaaacagagtgagactctgctctacagaaaaatgaaaaaaaaaaaaaaaaaaaaaaaaaaa

SEQ ID NO: 18110 - DNA, 330 bp, Homo sapiens
tcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcctgatttaaaacaa

SEQ ID NO: 18111 - DNA, 300 bp, Homo sapiens
  misc_feature 62, 131, 146, 148, 157, 207, 231, 257, 260, 275, 277, 290: n = A,T,C or G
tttgcatcatcatggcattaataaaggagacacatgatagtgggttggacttaaatggctgnggtgggaggtggtgataaatcgttagattctgggtctgatttgagggtagggcttcagaatttactggnagattatagtttggngngagagaaangagaggagcaaggctgactccaaggattttgcctcagcaataggaaaaangatgttgtcactttctaagatgangaccagggcaagaaaaagaagttttngangggaatagcaaggcncngttctacacaacntaaaattgag

SEQ ID NO: 18112 - DNA, 195 bp, Homo sapiens
tatgggacttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtgaaa

SEQ ID NO: 18113 - DNA, 126 bp, Homo sapiens
  misc_feature 27, 34, 85, 109: n = A,T,C or G
gagacatccaccaatatttgaaaatcnggctggncagagtgcagcggtgtttacaactaattgatcacaaccagttacagactangtgtcttctccagacctgctgctncacttgactagcctttt

SEQ ID NO: 18114 - DNA, 436 bp, Homo sapiens
gagcgaaggacggactaggcttggtgagagcgttagctgacgggaccggggaggctgcgatgggtgggttggagttctgaccgatggaagagttcactcatgtttgcacccgcggtgatgcgtgcttttcgcaagacaagactctcggctatggagccccatgttggtgctgattgttggaggtcttttggctggggagttttctcaaatccgatatgatgctgggaagagtaaaatggacctgagcttgaaaaaaaactgaaagagaataaaatagctttaggaggcggaatatgagaaaatcaaagactccaagttggagactggaagaatattcgagggcccagggccttgggaagatcctgactcctccaaggaagaaatccagaaagccttaagactaagacaactggctctgctgatcctttttcctttt

SEQ ID NO: 18115 - DNA, 350 bp, Homo sapiens
cttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtactggattgccacacggctcacattgcatgcaagtttgctgagctgaaggaaaagattgatcgccgttctggtaaaaagctggaagatggccttaaattcttgaagtctggtgatgctgccattgttgatatggttcctggcaagcccatgtgtgttgagagcttctcagactatccacctttgggtcgctttgctg

SEQ ID NO: 18116 - DNA, 349 bp, Homo sapiens
gcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgcaaagcttcattcttggctgcatgttgaaaatgtgattaaagttaatagaggag

SEQ ID NO: 18117 - DNA, 301 bp, Homo sapiens
  misc_feature 30: n = A,T,C or G
tctttgtgttgtctgcatttggaggagcancaatgtgggactatacgattcctattctagaaataaaattgaagatccttccagttcttggatttctaggtggagtaatattttcctgttcaaattatttccatgttatcctccatggtgggttggcaagaatggatccactatagcaggcaccagtgcttgcacctggctccacataggactaattattatactggcaataatgatctataaaaagcagcactgatgtggttgaaaagcatcctggctttatatcctaatggtgggatgg

SEQ ID NO: 18118 - DNA, 156 bp, Homo sapiens
ggctgaactttatcactatctgcttcattcgcaactaatatttgactttacatccaaacttgactttggcttcgaagccgccgcctgatactggcattttgtagatgtggtttgactatttctgtatgtctccatctattgatgagggtctcaaac

SEQ ID NO: 18119 - DNA, 342 bp, Homo sapiens
tgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgtatggaaatcagccaagttttataatccttaaatcttaatgtcctcaaagcttggattaaatacatatggatgttactctcttgcaccaaat

SEQ ID NO: 18120 - DNA, 300 bp, Homo sapiens
  misc_feature 93, 186, 241, 282: n = A,T,C or G
aataattaattccatgattatcacattctgccattaagggatattaagtaccgtaatactgaagaaattttattaagtctgaacttctggggnaggcagcttctttgtttcttttctatccacccttgcggtgaggatttgttcttgactaataaaccctttgatacttttaagccagaaatcagnctcataaagctattttggagtataggttggggaaaataaaaatgtttagcttggnaataacttccaagctgaactccctctagcaagaaatttttnagggctttaatttactat

SEQ ID NO: 18121 - DNA, 390 bp, Homo sapiens
ttgtgtgcggttgatatggctgtctggcattttcctcatgtgagggagcggcactcggacaacagcaagcttaccagagtacctggggggctggcagagcataagtacatccaggttgtctaccttcataacaacaatatctctgtagttggatcaagtgacttctgcccacctggcacaacaccaaaaaggcttcttattcgggtgtgagcttttcagcaacccggccagtactgggagatacagccatccaccttcagatgtgctacgtgcgctctgccattcaactcggaaactataagtaattctcaagaaagccctcattttatacccggcaaatcttgtaatgcattgctaaaaaataaataaaagctagatactggaacctaa

SEQ ID NO: 18122 - DNA, 393 bp, Homo sapiens
ttttactgtactaccattttggttacctacatagatgattgtaaagtacccactgtgatttaatctgacaggagcagtcaggttgatactatgtgtctctaaggagggctgtgtgtaattagcaatctctatgtttagaaagatgtctttaaaagataattttacactgagaattatggacttttttaatctcttgaattattttatctttactttactatctcaactccctcatctaaaaaatccccagcatccttgatatatttcaagcagcagttaagaatttttcctttaatacttattctttgtaaaggccaatggtcttgccctcttttgaactccactaatagacaccctctgtgtaaataacagtgtcacagtaaattatgaatg

SEQ ID NO: 18123 - DNA, 530 bp, Homo sapiens
tgtgaaaagaccaaatctacatctgattggtgtacctgaaagtgatggggagaatggaaccaagttggaaaacactctgcaggatattatccaggagaacttccccaatctagcaaggcaggccaacgttcagattcgtgaaatacagagaacgccacaaagatactcctcgagaagagcaactccaagacacatgattgtcagattcaccaaagttgaaatgaaggaaaaaatgttaagggcagccagagagaaaggtcaggttaccctcaaagggaagcccatcagactaacagcggatctctcagcagaaaccctacaagccagaagagagtgggggccaatattcaacattcttaaagaaaagaattttcaacccagaatttcatatccagccaaaccaagcttcataagtgaaggagaaataaaatactttacagacaagcaaatgctgagagattttgtcaccaccaggcctgcttaaaagagctcctgaaggaagcactaaacatggaaaggaacaaccagta

SEQ ID NO: 18124 - DNA, 300 bp, Homo sapiens
  misc_feature 172, 238, 248: n = A,T,C or G
aagcagaaaaacaaattgaagaaggccttttcttttgaggcatttagtcctctggaatttttcatggaaaggagaatctgttaggtagctagagctttcaccattctggtggatagtgtactatttcagtcagttaaactaaacatttaaagttgttatggttagttcaagngagagtttatggctaaatggcttttaatgaccctgaattttctggttaagcagacccatgtatcgngggggatagngcagaatataatatcttagggtcatctgggggatgataagattatcgcttgg

SEQ ID NO: 18125 - DNA, 279 bp, Homo sapiens
ggggctgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccagg

SEQ ID NO: 18126 - DNA, 460 bp, Homo sapiens
  misc_feature 446: n = A,T,C or G
tctgggatgaatgcacatatcacaaagatgcttctcagattgcttctgtcaagattttatatgaagatatttccttttctaccatagggcgcaaagcactccaaatgtccagttgcagattctacaaaaagagtttcaaaactgctaaatcaaaagaaacttttaattctgtgggatcaatgcacacatcacaaagaagtttctcagattgcttctgtctagattttatgtgaagatatttccttttctaccattggctgcaaagctctccaaatgtccacttgcagattctacaaaaagagtgtttccaaactgctcaatctaaggaaagtttcaactctgtgagatgaacgcagacatctcaaagaagttctcagaattcttctgctagtttttatatgaagatattaacttttccaccacatgcatcaaatcactccaaatgncacttgcagatcta

SEQ ID NO: 18127 - DNA, 130 bp, Homo sapiens
attagaggcgaacgacatgagctggggagaattaaggatattattcacctacaggaaaagctaatcgatgctaagtgttcctttggctggacatggacaatcatataggcttggggagttaccaccctaa

SEQ ID NO: 18128 - DNA, 324 bp, Homo sapiens
atacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgcacag

SEQ ID NO: 18129 - DNA, 390 bp, Homo sapiens
gcattattcatttctccagctctgccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgcttcctcatcctcttcgcatgtgaggctccatggggggtcaccggcctgtgctactgcaactccacaccattcttggtgctggggtgtgttaagcttt

SEQ ID NO: 18130 - DNA, 303 bp, Homo sapiens
  misc_feature 31: n = A,T,C or G
ttgtcttagataaatatatttacagtccttncctgataattcgactccagcttcagatgcttttttcaagttacatctgttcttggaaccatttttttctttatgtccttctttggtcttccagtttgaaaacactctctattattcaaatacttcctaaaatacgacatcctccaataaagtttttaaaaactacttagacgacacttttatggccaatataaaaataccattcaactatataagagtttaagatttgccaggagggagctcatggtcattccttcaaaactattcatccat

SEQ ID NO: 18131 - DNA, 359 bp, Homo sapiens
attaaggaacctatggaccttgccaccatggaagaaggagtacaaagacgatattatgaaaagctgacggaatttgtggcagatatgaccaaaatttttgataactgtcggtactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcg

SEQ ID NO: 18132 - DNA, 370 bp, Homo sapiens
accaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctgccaaggtacagagagctgtgtgcatgctgagcaacaccacagccattgctgaggcctgtctcgcctggaccacaagtttgacctgatgtatgccaagcgtgcctttgtcactggtaccgtgggtgaggggatggaggaa

SEQ ID NO: 18133 - DNA, 300 bp, Homo sapiens
  misc_feature 38: n = A,T,C or G
taacttttttaaaaagtaacatttcctgaaaataaaanagaaatgattattttctcaaaatgcagtcaattgtatttgataattaaaaagatttcttatgataccttttctgattgagttttcagagatactttttcttttcataacccataaaactttaatgtaagaatggtaatttaggggaagaaagtaagtcaggtaaaatcaactggaagtctgtacgacgtaagagtttgttttttattcatctggttttaaattaaagttacaacagtaaatgctatatgtatatattacaac

SEQ ID NO: 18134 - DNA, 300 bp, Homo sapiens
caaaaattgtaatggataggacaaaaagttaatacccacccatggtatatttcagactatatatagtatatatatgtaattaataccattctgggtgtcactgtttgagaggggccttgttaaacaagaataaccagaagaaggaaaccaagatggtgaagggtttaagagcataaaacaattaaagacacattaaagaagccattaaaggatgtttgggagtgggaattctgctgcatcatgactcaaaaaaataatgatcatattaaaggggtactggagggtaggggagaataaaat

SEQ ID NO: 18135 - DNA, 297 bp, Homo sapiens
gctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttt

SEQ ID NO: 18136 - DNA, 256 bp, Homo sapiens
gattcgcaaacttctcttccagcgtctggtgcgagaaattgctcaggactttaaaacagatctgcgcttccagagcgcagctatcggtgctttgcaggaggcaagtgaggcctatctggttggctttttgaagacaccaacctgtgtgctatccatgccaaacgtgtaacaattatgccaaaagacatccagctagcacgccgcatacgtggagaacgtgcttaagaatccactatgatgggaaacatttcattct

SEQ ID NO: 18137 - DNA, 228 bp, Homo sapiens
  misc_feature 23, 26, 33, 40, 52, 61, 63, 78, 86, 100, 135, 151, 154, 179: n = A,T,C or G
gaaaaaaaggatttccacttaanggnacaacanaattatngctttcttagangtatgggtngnaaaagtcaatatacncatttatntaatttctttcttnaaaatcttatacctaattggatatttctaaaaatngcacatgtaagcatgngtntaacatgctaaagtactttaactgngatcttaaaactgaataaaaatatttaataaaactttcaaaaaaaaaaa

SEQ ID NO: 18138 - DNA, 219 bp, Homo sapiens
tggaggaagaaattacaaaacctgagaggacccacaggccccctgaaggaagcagatggctcctgcaggacccaggagacacaccaaatactgtgttaggtatttacttacagaaatgcaaaatggtctggaaagtctcagccatagaatcaaacaagtagaagaaagaaattcagagctcgaacacaaagtcttcaatttgacccaatccaaccaaga

SEQ ID NO: 18139 - DNA, 395 bp, Homo sapiens
cttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagagga

SEQ ID NO: 18140 - DNA, 320 bp, Homo sapiens
ccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagcctctggtagcaataaaaagttgcct

SEQ ID NO: 18141 - DNA, 284 bp, Homo sapiens
  misc_feature 50, 188, 200: n = A,T,C or G
aggacaaaacacctatcaagaaggaggaaaaaccaaaaaaaggaagaggngaaaaaagaagtcaaaaaagagatcaagaaagaagagaaaaaagaacccaagaaagaggttaagaaagaaacaccgccaaaggaagtcaagaaggaagttaagaaggaagagaagaaggaagagaagaaagaagaggngaaaaaagaagncaaaaaagagatcaagaaagaagagaaaaaagaacccaagaaagaggttaagaaagaaacaccgccaaaggaagtcaaaaaaaa

SEQ ID NO: 18142 - DNA, 407 bp, Homo sapiens
gccagcctcaccctaataccaaaaccaggaaaggacataaccaagaaagaaaactacagaccaatatccttaatgaacatagatgctaaaacccttaacaaaatactagctaaccgaatccaacagcatatcaaaaaggtaatccaccattatcaagtaggttacataacagggatgcagggatagtttaacgtacacaagtcaataaatgtgaaacaccacataagcagaattgaaaacaaaaatcacatgatcctctcaatagatgcagaaaaaagcattcaacaaaatccagcattcctttatgattgaaactctcagcaaaatcggcatgcaagggacataccttaatgtaataaaagccatctatgacaaacccacagccaacataatattgaatggggaaa

SEQ ID NO: 18143 - DNA, 233 bp, Homo sapiens
gctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgc

SEQ ID NO: 18144 - DNA, 449 bp, Homo sapiens
gagacatttctaaggggcatggctattgctgactgggctgacgctgctaggatgaagttagcccagagattgtatttactcatggatcactttatttatttcacatttactcagaatgatcctttgggttctataaggacataaggtacaatttgccattgctctccatttttaaaaacatacaagtcagtgtcaagcttaccaacatgacattttttcagcagttgtggtaggccagccttgaagccatcgcacaggtctagaaacttggtagctgagtgggcagctcacctttaagggtgaaggtaggtaaaagcaattaggcagaggcgtatctatgtgatatgtgcctcctggcagtatggtgaatttatagcccttcaatgaataaaaaaaaaattggatataccaaggtttttagttaaataaagagcaccctactacggcgg

SEQ ID NO: 18145 - DNA, 318 bp, Homo sapiens
atatatactttatgccatttctgacggtgacccaaaaatttgtttcaaaactgatactgtatgtcaaaagtgtacatgtctcatgcacctgtcattttctgtgttagccttgtgaggaccatctaaaattctactgtttttatcaatggaaatctttcatctatgtcttgatcagtcattctctttttctgtacacacatacagtggcgatatctgtgcatacatgtgcatgtatgacacgaagtcatacatgtatggataaatacatcacagcttcttttcagatacaatatttttaaaaatttcactttatgtgtg

SEQ ID NO: 18146 - DNA, 450 bp, Homo sapiens
atatcctgatggtagagacagactccaggcagccctggacttgctagcccaaagaaggaggatgtggataatctgtttcacctgggttgtcctaaggccatagttaaaaagtaccagctctggctggcgtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctggcagtcaggggcaaggactgttggaggagagttagcccaagtataggctctgccagatgccatcacatccctgatactgtgtatgctttgaagcaccttccctgagaagg

SEQ ID NO: 18147 - DNA, 307 bp, Homo sapiens
tatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgctcccagctccacagcaatgttgtcaactatgtccagcagatcgtggcacccaaggcaggtagaggctcgtgtgcatggcccctgctcttcaggctctccaggg

SEQ ID NO: 18148 - DNA, 108 bp, Homo sapiens
taataacttatttttaacatgtccaaaataagttttagaaacttctgttggagcctggctacccgttttctcctccgcccttcttgtggataagcattggttcaatat

SEQ ID NO: 18149 - DNA, 453 bp, Homo sapiens
ttagacacaaaatgatcagtgttgtagaaacatgattccggactgtgcaagtaaaagtacaaacattagggtccaccataaagtatgtattgaaatcaagttgctctgtgtacagaatacatacttattcccatttttaagcatttgcttctgttttccctacctagaatgtcagatggttttcagttatctccccatttggcaaaggttgcctcaagataacatttttcattaaagcatctgagatctaagaacacaattattattctaacaatgattattagctcattcacttatttggataactaatgatcacagctattatactactttctcggtattttggggggcatgcctcatttccctgacttaaacctcactgagagcgcaaaatgcagctttatacttttaacttcaattgcctagcacaataggggagacatttggaatgga

SEQ ID NO: 18150 - DNA, 300 bp, Homo sapiens
  misc_feature 24, 206: n = A,T,C or G
caggtggcactgaaagccatgggntctgaagaggcgaatttgttgaaaagtcccaagggctgaatgaaagcatctttaatcaacactcaacactcgcaatattctagaaaaccatatactgtgctggttgaggccaaaggttaacattgctccactgttcaccaaggaagggggcagtggccatccgcgcggctcacgtgcgttgnaacaagccctcatcacatgtgtgagcttacgtgcacaaaaagagaaggctttggactgaaactggcaccttgtgtactcgataccttcacagct

SEQ ID NO: 18151 - DNA, 326 bp, Homo sapiens
gacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggccttccagtctcatcatacaaaatggcaatcttggctgggtgcggtggatcatgcctataatcccagtgctttacaaggctgaggcaggaggctctcttgagaataggagttcaagaccagcctggcaacatagca

SEQ ID NO: 18152 - DNA, 308 bp, Homo sapiens
  misc_feature 30, 31, 87, 93, 120, 140, 201: n = A,T,C or G
gttccctagggataacagcgcaatgcctannctagagtccatatcaacaatagggtttacgacctcgatgttggatcaggacatccngatggngcagccgctattaaaggttcgtttgtncaacgattaaagtcctacgngatctgagttcagaccggagtaatccaggtcggtttctatctacttcaaattcctccctgnacgaaaggacaagagaaataaggcctacttcacaaagcgccttcccccgtaaatgatatcatctcaacttagtattatacccacacccacccaagaacagggtttgc

SEQ ID NO: 18153 - DNA, 410 bp, Homo sapiens
gtatatgtgcctgttatccttttaaattaaacacatgaatatgtgaattacactcaaagtattcttctctgtaaaaattacagtagtcataactacttataaatgataacctgaagcccagttacttcatagtcctttaaattccatttgataagcatgttgtgtattgtttaggccttgctcgcttcatttgttcatcagccattcatccaaaaaaattttgaggatctgccatacggtatgtctgtttgggctggctaagacaatgaataaaatgagattcctgaggggaatcacagtccaattagagaactgggtgcagatgaaccgataggtatactggagtgtggaaggattacagtgaggggcaagaaactgcctgggaactaaattgccggtaagacaacatt

SEQ ID NO: 18154 - DNA, 168 bp, Homo sapiens
gaagaactaatgttagtataagtaacatgaaaacattctcctccgcataagcctgcgtcagattaaaacactgaactgacaattaacagcccaatatctacaatcaaccaacaagtcattattaccctcactgtcagcccagaaaaaaaaaaaaaaaaaaaaaaaaaa

SEQ ID NO: 18155 - DNA, 304 bp, Homo sapiens
  misc_feature 32, 238: n = A,T,C or G
cattgatcacctgggtttctttatttatcgantgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgacagcaagaaaaacattattgaggaaaattaatatcacagcataaccccaccctttacattttgtgcagngattattttttaaagtcttctttcatgtaagtagcaaacagggctttactatcttttcatctcatt

SEQ ID NO: 18156 - DNA, 336 bp, Homo sapiens
aagggattgtaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcaggtggataagaggaatt

SEQ ID NO: 18157 - DNA, 460 bp, Homo sapiens
gaggctggcggcgcaggggcttctgctgagggggcaggtggagctcggggccgccgcggacgagatgttttctctttgatagatagagattaatacaactacttaaaaaatatagcaataggttactaagatattgcttagcgttacgtgttcaacgtatttttaatagcttaggatttgaagagagaatatgaagacttagaagagtagcatgaggaaggaaaagatagaaggttctaaaacatgacggaggttgagatgaagctcttcatggagtaaaaaatgtatttaaaagaaaattgggagaagggcctccggagccccgattaataccaatggaagggccatgcctttaggattaaaatggaggggacttaaaccgcttaaagtttagttaaaaagtggaggggattaaaataattggaggcggtctttttaaaaagagataaaccgaggtggg

SEQ ID NO: 18158 - DNA, 307 bp, Homo sapiens
attaccagcaagaataaaaaagaaatccatatcttaaagaaacagctttcaagtgcctttctgcagtttttcaggagcgcaagatagatttggaataggaataagctctagttcttaacaaccgacgctcctacaagatttagaaaaaagtttacaacataatctagtttacagaaaaatcttgtgctagaatactttttaaaaggtattttgaataccattaaaactgcttttttttttccagcaagtatccaaccaactggttctgcttcaataaatctttggaaaacccaaaaaaaaaaaaaaa

SEQ ID NO: 18159 - DNA, 420 bp, Homo sapiens
ccagggtagggattttcatggaaaatataaagcattttattaaggcctttaaaaattccacacagaacacggcttaagcagaacatatgcagctgcttagttgaaaaatggaactggcagcttaacccagaatgtgagacttctaaatacattcaaattgagtcatcatcatttttcatctatgtagtattttgtttttccaaagttcttacaatttctgactccaagatggcaaaattgtaccattattcctatgttaaagttaatgccatgtctactatagcttggcagccattttgactcaactgtctaatctaaatgtcatttcaatcagaaaaccagccatcaactgtcaaaatggtaaaaacagttatgtgtgttttcaaagccagaagtgcaatcatgtggtgagacttcagg

SEQ ID NO: 18160 - DNA, 301 bp, Homo sapiens
  misc_feature 293: n = A,T,C or G
acccatgttgagacctcagcttggcactcaggtgctgaagggtaatatggactcagccttgcaaatagccagtgctagttctgacccaaccacagaggatgctgacatcatttgtattatgttccaaggctactacagagaaggctgctgctatgtatttgcaaggctgatttatggcagaatttccctctgatatgtctagggtgtgatttaggcaagtagactgtgattcttagcaaaaaatgaacagtgataagtatactgggggcaaaatcagaatggaatgctctggnctatataa

SEQ ID NO: 18161 - DNA, 352 bp, Homo sapiens
tgctcattacttccaagatcctatggataatagaaataaactctctctgggaaaatctcccagggcagacataagtgtgaagaagaaactatttggctctgtggtgtggattgatgttaccttactgttattatgccattctaggccataaaagacatccaagccagaaaaagcggtatgctttttaaaatcatgatttcactttttttcaacatagaaaagttcctggacttttctaaaagcagtgtgctgtcaccattaggattatgttgctggcccagtacagtggctcatgcctataatcccagcactttgggaagctgaggtaggtggatcacttgaggccaggagt

SEQ ID NO: 18162 - DNA, 290 bp, Homo sapiens
  misc_feature 40, 70: n = A,T,C or G
tgttcattataatctcaaaggagaaaaaaaaccttgtttnaaaagcaaaaatgacaacagaaaaacaatnttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgccaacaataaacaggaattttattttgctgagttgttctaa

SEQ ID NO: 18163 - DNA, 198 bp, Homo sapiens
atattgaaagatataaaaagcacataattcatatttcaggtggtatttgcatacagtgccttactggtattctcagaacattttaatgatttctaacatttcttaacagtcatagatatatacattttcattttttgtacctgaatattctaaataaaactgacatctactcttgacaaataaaacatatatttacga

SEQ ID NO: 18164 - DNA, 349 bp, Homo sapiens
ggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggat

SEQ ID NO: 18165 - DNA, 370 bp, Homo sapiens
aaatatacaaaaccctacccttattttacatcaggtcaacattaaaaataaaaattcaaatatcttgctttagaaatttgaaaataaggccaggcgcattggctcatgcctgtaatcctagcactttgggaggccaaggcaggcagatcactttaggttaaaagttcgagaccaacctggccaatgtggtgaaatcccatctctactaaaaatacaaacttagctgggcttggtgatgtgtgcctgtagtcccagctactttggaggctgaggaaggagaattgcttgaacccaggaggtgaagcttgcagtgagccaagatcgcgccactgcactccagcctggcaacagagtgagactctgtctcaaa

SEQ ID NO: 18166 - DNA, 281 bp, Homo sapiens
  misc_feature 31: n = A,T,C or G
agtagtacctagagaaaattggtagccttanatatatctagatatccagaaaagaaaggctacatatcaattttttaactttcaaataaactataagaagaatagcaaatcaaacctaaagaaagtagaagaaaggtaataataaagctaagaacagaaatcaataaaacagaaaataaatatattgtagagaaaaattaacaggctaaaagttggtattttggaaaaattaatgaaattgatagacccctagcaggactaatcaagtgaaaaaaaaaaaa

SEQ ID NO: 18167 - DNA, 321 bp, Homo sapiens
tgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagc

SEQ ID NO: 18168 - DNA, 281 bp, Homo sapiens
caactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaatttcattaaaaatattggtttgaatt

SEQ ID NO: 18169 - DNA, 363 bp, Homo sapiens
gccagaaaccctgaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggat

SEQ ID NO: 18170 - DNA, 153 bp, Homo sapiens
cagcagtgattaacctttagcaataaacgaaaggttaactaagctatactaaccccagggttggtcaatttcgtgccagccaccgcggtcacacgattaacccaagtcaatagaagccggcgtaaagagtgttttagatcaccccctcccctt

SEQ ID NO: 18171 - DNA, 262 bp, Homo sapiens
tacatgtgctctgtctccagagatacctctaaaagttctaggttttagatgaacgattccccaaagcaaccttcacctggagaacataattcctatatttagcttaatacttggccagaaaggctaacatgtcatttacagtttacaggtaagatgaatgtaatctccttagagtagtttcatcaaccaagtctagaaaaatcaggtactagagtgattttcacacaactgtttcttattgaacaaattacaaaattaggag

SEQ ID NO: 18172 - DNA, 330 bp, Homo sapiens
aatactctggagggattggggtaatgcaccaaaagggtacttggatatagtattcttcatatcaaaagatcattctagtaccgtggttctcaaactgtggtgtacgtacatcagaattacctgagagcttaataaaatgcatacattgcgcccccatgtctgagtcaggagtaagagactaagaaaatttgtctttctaggccaggcgcatgtctcatacctgtaatcctaggactttgggaggctgagcagggtggattgtccgacccaggagtttgagaccagcctggccacatggggaaacctcatctctctaaaatacaaaaatta

SEQ ID NO: 18173 - DNA, 342 bp, Homo sapiens
agagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagtccacaaggttactgtatacatagcctgagtttaaaaggctgtgcccacttcaagaatgtcatggt

SEQ ID NO: 18174 - DNA, 258 bp, Homo sapiens
attcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcagg

SEQ ID NO: 18175 - DNA, 400 bp, Homo sapiens
  misc_feature 31, 303: n = A,T,C or G
tataaagtgcttggcatagggccaacacagngtgatcatgtaatagatacttgattttttaaattttctctaattttattgtcctgtatgtatagatttaattttcaagtgcagagtcaaaagatattaaatatatttttgaattttgaaacgtgattaaaggaaaaccaaatcctaagtgacctaaaattcatattgggttttaatttaccgggtttgttttttacttagcactaaatctcttacaatatagagtgttgctttgctactgtaatcaagtcacacctgcaacggactttaagnttaaaagatcaatgtagaaaatgcattcttactatcctagggcatttttttttaacctccttaaccatggcatttggaaggttgggacatgaaataa

SEQ ID NO: 18176 - DNA, 183 bp, Homo sapiens
atggtggaatgagcagaacctgaaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgaaaaaaaaaa

SEQ ID NO: 18177 - DNA, 331 bp, Homo sapiens
atatgccaggctctgggctaagtactttaaatgtattatattatgtaatcttcaaaacaaccttatgttctaactaccattattaataggttgtttttgtcacaatgaggtaacagaagttaagggaaactatgtaactcttcaaaagttatacaactaaaaagtggcaggactcagatgagagcgggcagggtcagaaggccagccaggtcttcttagttcgcttttcaccatgtcgtcttgctactggcttgggggaacccctgggtaagaaccaggtggatgcagagtcacggctgggacagatgtctcggaagtcagatgactttgg

SEQ ID NO: 18178 - DNA, 252 bp, Homo sapiens
tgcgcaagatgggagcgcccgaatctggcttggcaggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaatg

SEQ ID NO: 18179 - DNA, 300 bp, Homo sapiens
  misc_feature 39: n = A,T,C or G
taaactcggccacgaagagcagcaaaaaagactgcagtngatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagcctttaggaagcttcacttaaaggacaag

SEQ ID NO: 18180 - DNA, 204 bp, Homo sapiens
  misc_feature 30: n = A,T,C or G
tattgagggatgaacaaggggatggctaangatccaatggagcctgggaggtgtgcccagaaagcttgtctgtagcgggttttgtgagagtgaacactttccactttttgacaccttatcctgatgtatggttccaggatttggattttgattttccaaatgtagcttgaagtttcaataaactttgctctgtttttctaaccc

SEQ ID NO: 18181 - DNA, 320 bp, Homo sapiens
acagcctctaacaaaactaggctgtcccgaacccctggtaatagaattgtttacctttataccaagaaggttgggaaagcaccaaaatctgcatgtggtgtgtgcccaggcagacttcgaggggttcgtgcttgtaagacctaaagttcttatgagattgtccaaaacaaagaaacatgtcagcagggctatggtggtccatgtgtgctaaatgtgtcgtgacaggatcaagcgtgctttccttatcgaggagcagaaaatcgttgtgaaagtgttgaagcacaacaccagagcaggaaagctaaataaaaaaatgaaac

SEQ ID NO: 18182 - DNA, 318 bp, Homo sapiens
tgtttaaagcaaaaataataactcgcatagtggggcctatagtatacataggagaaaaatttgttaccacagtagcacagaggatagtatggagacgtgaagcccttacattatatgtgaagtggtataatatataaaggtctactgtgggaaggttaatggtttatgttgtaatgcctagagcagtcataaaaaaataagccggtaaagaaaatggaatactaaaaactactgaatccaaatgaaggcaggaatagagaaggaaacaactaatgggaaaaatagacaatgaaaaggcaagatagtaaacttaggttg

SEQ ID NO: 18183 - DNA, 280 bp, Homo sapiens
cctcttggctctcctttccaagagcggtaatacttgtgttattcaagaacagccattaggtgtcctgaaatttcagaaccgaaaaatcttaaaaaaaattattttttaagtagcctgtacaatagaaacttcaattatggagagacaaagagtatacctgttactgatgtagttactttgttgagaatgaaaactgtttctggctggtaattactgaatgctttaaacaaaaaaaggcaaaggaatggtaggaaataggcaagacaaaaaaaaaaaaaaa

SEQ ID NO: 18184 - DNA, 300 bp, Homo sapiens
  misc_feature 156, 260: n = A,T,C or G
ttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgngtgctgacttgataagaggcgcaaaagaaaagaatctcaaagtgaaaggaccagttcgaatgcctaccaagactttgagaatcactacaagaaaaactccttgnggggaaggttctaagacgtgggatcgtttccagatgagaa

SEQ ID NO: 18185 - DNA, 400 bp, Homo sapiens
  misc_feature 343, 344: n = A,T,C or G
ctggaaatccaattaacaattttacaacataagatagaatggagacctgaataattctgtgtaatataaatggtttataactgcttttgtacctagctaggctactattattactataatgagtaaatcataaagccttcatcactcccacatttttcttacggtcggagcatcagaacaagcatctagactccttgggaccgtgagttcctagagcttggctgggtctaggctgttctgtgcctccaaggactgtctggcaatgacttgtattggccaccaactgtagatgtatatatgggcccttctgatgctaagactccagaccttttgtttttgcttnnatttctgattataccaactgtgtggactaagagcattaaaataaacatcagagtac

SEQ ID NO: 18186 - DNA, 300 bp, Homo sapiens
agaaagcattctttgctctaggagaagagcagctgctgcagatacagtaagaaactctgaaatcccagcactgtgggaggctgaggtgagtggatcacccgaggcaggagttcgagaccagcctgaccaacgtggtgaaaccttgtctctaataaatacaaaaaattagctgggtgtggtggcgggagcctgtaatcccagctacttgggaagctgaggcaggagaatcgcttgacccgggaggtggaggttgcagtgagccgagattgtgcactgcacttcagctgggcgagagggaaa

SEQ ID NO: 18187 - DNA, 242 bp, Homo sapiens
aaatgcagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaa

SEQ ID NO: 18188 - DNA, 300 bp, Homo sapiens
aagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattgga

SEQ ID NO: 18189 - DNA, 290 bp, Homo sapiens
  misc_feature 37, 40, 44, 48, 64, 78, 90, 113, 122, 196, 210, 211, 216,253, 256, 265, 266, 267, 272, 277, 282, 284: n = A,T,C or G
ggagtggacatgtagtggtagcaggctcttgtaaatnagnagtncatngcattacctaattggncaaatgcatttttngctgcaagatcnccgacagaccataccctggaggntgcaagggnttcatttggcctattttggcagcatgttgagcatctaaagtttggattctttagttcttctcaaatatgaactnaccattattatggnnatgancctggaagctaattttttttaacccttcatacctacnggnaatcatggnnnttccnggaanaaatntnaaaata

SEQ ID NO: 18190 - DNA, 300 bp, Homo sapiens
ccttcaggcctttcctttggttctttgagcatctttgcttgcatacgtctcccgctttggtctccagttcaaattattgcaaagtaaaggatctttgagtaggttcgggctgaaaggtgtggctttatatttgatccacacacgttggcttttaaccgtgctgagcagaaaacaaaacaggttaagaagagccgggtggcagctgacagaggaagccgtcaaataccttcacaataaatagtgcaatatatatatagtttaagaaggctctccattggcatcggttaatttatatggtat

SEQ ID NO: 18191 - DNA, 500 bp, Homo sapiens
  misc_feature 363, 447, 460, 464: n = A,T,C or G
tgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgccgagaccttcaaggtaacccaattgcgaatgcaccatctccgtggaaggaatagaccacgatgttacatccgcaaaggatgggggattactggagatngcttatacctggaactataaacttacagcctcagtccaggctatctggcaataacaaagaaaggggaggtcctacagcctgcgntggggtggatttngacnggggcattttctgaaggaaagaagaggagaaggaag

SEQ ID NO: 18192 - DNA, 310 bp, Homo sapiens
gaaagtattaggaaaacgaaatacacattatgaaacttctatcactcctaaagaaaggggaaaacctattaaaaatgaagctcttatttactaatgcatttctatttcaggagcatttggctaaactggggacaaaaaacaaaaacttgttcttaattaacaaaagaactagaaagaagctcatatgaaagcaccaccttgtgttcagtaagcttcaggatagctctgttgacagcaggcatttagagagtccaagtatagtcatgtatcactgggggaggaagaatctttgaggaatctagttacaatc

SEQ ID NO: 18193 - DNA, 279 bp, Homo sapiens
caacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctcccccaatataaaaatatagactt

SEQ ID NO: 18194 - DNA, 370 bp, Homo sapiens
aatttcgcagagctgaagatcaagcgcctgataaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaagcttcgattaacatgctgaggattgtagagccatatattgcatgggggaccccaatctg

SEQ ID NO: 18195 - DNA, 300 bp, Homo sapiens
  misc_feature 41, 71, 72, 89: n = A,T,C or G
gcagagaagagggagaaagcagcatcttgcctggatgattnaggggacacagaagagaagcccactatctnntttaatctttacaactntcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttcc

SEQ ID NO: 18196 - DNA, 194 bp, Homo sapiens
cgtaaggctgttagtcttttctcttgcccacgccagtatcgccacgagcaagaacgatcttcctaaagcaccaattatctttccaaaacagaagattttctcttctttgtaggaatgtaactttagggcatagacagataaattagccaaaatatatgtgaagaagctgttcatcacaatattgttgattatag

SEQ ID NO: 18197 - DNA, 444 bp, Homo sapiens
ggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgt

SEQ ID NO: 18198 - DNA, 390 bp, Homo sapiens
aaatggaattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatggcaaagaagtaatcatgtagttgaagtctgtggatgcagctgttatgaagatggttaaacttgaaacaaacaattttaagaattatttggtctgaagatgtttactttaaataaatgtcta

SEQ ID NO: 18199 - DNA, 307 bp, Homo sapiens
tcgctgcagtattcttaggtaaaatctttttgctgtttctggcggcggaaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggcttaattcttacatgcaggaacactcagcagacacacgtatgcgaagggccagagaagccagacccaaaaaaaaaaaaaaaaaaaa

SEQ ID NO: 18200 - DNA, 310 bp, Homo sapiens
  misc_feature 68, 77, 188, 205, 231: n = A,T,C or G
ttgctcacgaccccagattgtaccagagcccatggatttcagaaaattatctacattcagagaaagtnttaagaaangagtgataggacaagaccacgacttttcagaatccagtgaggaggaggcgcccgcagaagcctcaagcggggcactgagaagcaagcatggcgagagggctctatgacttntagaagtacatctactnggagaatacccagcaggaagagacgnttcagcagtagtgacttttcagacctgagtaatggagaagagcttcagggaaacctgcagctcatccctaagaagaggg

SEQ ID NO: 18201 - DNA, 303 bp, Homo sapiens
ttgaaataaattaataaaacaaaaaattgttttttaaagttaaacaaaacaaacttctaaccagactaagaaaaaaagaggaaagatccaaataaataaaatcagaaatgaaaaaggaagcatgacaattgatactgcagaaattcaaaggatcattagtggctactatgggcaactatatgccaataaattggaaaatgtagaagaaatagacaaatttttagataaatacaacctaccgaaattgaaccaggaagaaatccaaaccctgaacagaccgataacaagtaatgagattgaagg

SEQ ID NO: 18202 - DNA, 322 bp, Homo sapiens
cggataaaagccgcactcctgatctgtgtgcatgtgtattttgtactgactcttcaggacggacatgctctttcctccttcacttagttttgccatgcagaaggcaacagaataaaatttgatattttcagataataagtattttccacgctgagacatgattttgctttgaaatgaatttcttagtaattctgaatgtacaaatatgccaagaggtttttcagagtaagctacattttttttccagtgaaaatgtggaaagtgcctgagaactttatgaacaagcttcttttctagccacgtaactattgtatgcaaaaaa

SEQ ID NO: 18203 - DNA, 226 bp, Homo sapiens
  misc_feature 19: n = A,T,C or G
ggcaggtagcttaaagagngggggatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaa

SEQ ID NO: 18204 - DNA, 421 bp, Homo sapiens
ttgctgggagctgtgatcgagtgacctgcattccagccagatgtgacagggtgagatcctgtctctaaataaataaataaataaataaagtttaaaaacaaagaaagtgggagtaagtgtggcaaattatctttgatcatctaactaaggctttgctatcaactaattttgatcttccacttcagagaatagttctattctattattcagtgaataagtatgtgtgtgggcctaactgcatggatgctatagatctcttactttaagtaatgtaggtattacataaagactgctttgtagaaagtatttgctaagtgcacttttagattttcaatacgaaggcactgtaggtcaagccttaaaaaatcagaggtattttgcttgccaggctttttgagcaaacaaaaccaccaaccttaac

SEQ ID NO: 18205 - DNA, 301 bp, Homo sapiens
  misc_feature 30: n = A,T,C or G
cagtattctcagagataccatcagagaacnaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctca

SEQ ID NO: 18206 - DNA, 400 bp, Homo sapiens
  misc_feature 40: n = A,T,C or G
tgctattccttctccctccagaagggatggaaaccctatnttcttttctccaagaccatggttggtctgcttccctcactcgggctccttgacagtcttctagaagagagaaggaggaaaagaagcagttcctgatgttacaaatgaacaaggatctcccaggtaaccagctccccacacccatttctgttactaatttctcaaacagaaatttctggttccccttcttccttatcactgagtgaaaggggacaggcatgcacatgtgcccatacatgcattcagaatagagtgtgggggcaggggcggtagttcattcctgtaatcccagcactttgggaggctgtgcaggtggatcatttgaggtcaggagtcaagactagcctggcaacatactgaa

SEQ ID NO: 18207 - DNA, 272 bp, Homo sapiens
atataaactgttaatagtggttacttttaaggagagagactaaggttgggttgggggaagagaaagaaattggtattattttatccttctatactgtgtgctttttttattattttcatgtatttcatttcttcaaaatgtaagaaatgttaaaaatgtatgtgcaaaacaatacaggccactgtactgtgatataatcagatttacattctgacaatgtagatttttttaaatcatgcattaaaacaaatcctgtttcttttaaaaaaaaa

SEQ ID NO: 18208 - DNA, 340 bp, Homo sapiens
tcgaagagatagagatatctgtcctaagattcttattgtatcttaagagaccctagataatcaaaagagtcttaaaaaaagaaagtttaacaactcacttcctggtttcaaaacttgccacaaagctacagagataaaatcaatgtagtactgacataaagacatataaacgaatggaatagaaataggtatccagaaaaactatgtgtctgttgtcaactgatttttgacaagggtaacaagaccattcagtggaggaaaggacagttttcagcaaatgggctgggaaaactggatatccatatgcaaaagaatcagttggcctttacctacaatgtat

SEQ ID NO: 18209 - DNA, 301 bp, Homo sapiens
cagcatttcttttcatgagcccggtgaaggaaggggatgtatcagtgaacacagaacctcaccttttaagataaatttgaaaaacaaacgagcaaacaaaaaacaagcttacttttccctctcctcccctcttccctttaccaaaaacaaaaacaaaaacaaaaaccaccaacaaaaacaactctaaaattgaatcagtgttggccatttgatttggaatgtcatataacagtcttgcacagttatatagggaaagttaagcaatcaaaaaaggttgctacaaaggccaagaaaatgaacc

SEQ ID NO: 18210 - DNA, 450 bp, Homo sapiens
  misc_feature 24, 71, 359, 379: n = A,T,C or G
gctgaaggagcaacctaaaaagtntcccctgcttatgcttctccagttggccctccatgtccataggcttngcatctgtgattcagcccactgtgggtcaaaaatatttggggaaaaaaaatggatgggtgcgcctttgctgaacatgtacaaacttttttttgtcattaaacaatatagtataacaactatttacaaagcatttacattgtattagctattataggtaatctagagatgatttaaagtgtatgggaggatgtgcacaggttatatgcaaatactacaccatttctataagggacttgaacatcatggactttaggatcctaagggggtcttggaacccatcacccatnggggcaccataggacaactnttgcaccgggtttatttcctattaattcagggtccggttaagaggcctaaaactaaaacctaatcatttag

SEQ ID NO: 18211 - DNA, 300 bp, Homo sapiens
  misc_feature 31: n = A,T,C or G
agatactaatgctctgcgtgttccgaggganaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgatttt

SEQ ID NO: 18212 - DNA, 320 bp, Homo sapiens
  misc_feature 50, 55, 63, 67, 76, 85, 87, 102, 113, 134: n = A,T,C or G
aattggaaatcaatcctgttaagagataattctttaaagggaaattaggnatggnatagaganggtnattcttagnattgttatntnacagatgaattctgnctaagtaagtnaattcatatttatactatatngtatttaatgtatttataagtactctttaaatacaattctttggaagataatgccttaaattaaggctgttcctctctctatttctggtaaaactagcactgtattgctggcagtggaggaggtatatattactataggagaaaggcaagagatcaggcaacccaagaggatatgaaaggtaaaca

SEQ ID NO: 18213 - DNA, 591 bp, Homo sapiens
  misc_feature 2, 3, 4, 8, 11, 12, 21, 22, 24, 25, 32, 35, 40, 51, 55, 73,97, 114, 115, 131, 132, 148, 381, 566, 577, 591: n = A,T,C or G
gnnncggnggnncgggggtgnnanngatcctnagnaggcnctcggttatgnggangggcccggcaaacctganggcctcagaatggcgggcacaggntttttggctggagaggnngcggtggatgcgctgnngtattttgatcaaggntatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggcaaaaaaatgacatnactgcatggcaagaatgtgtaaacaattctatggcccagttagagcatcaagcagttagaattgagaatctggaactaatggcacagcatggatgtaatgcctggaaagtatacaaaggaaaatctagtcatatgatggacccccccagaagggactcagaagttaagaaacatattcaagattnaaccgggaganaagacatgcactcn

SEQ ID NO: 18214 - DNA, 102 bp, Homo sapiens
aagttcataagactatgagtgggctcagtaggaggacttcattttatctggaaattgaaagacatccagaagtagagttaagatctacagaattatcagact

SEQ ID NO: 18215 - DNA, 301 bp, Homo sapiens
atatgtttaggagatctaaaaaagtcaaagtaatgaacatataggttaaattatgaatagaaagcaggattttcaaaatatttaacatattttagtgaatgatacatcagactaatactctcagtgatatcaggagtaacacttaggttaaataatctgttcattatctctggatacatccaagagtctgttgccaattccattgcctcatttttgagcttctctcattgtaagacaagggatgcagtcagggctgactaaatgacagttatcaactgtcaccagaccatttgaaagtgaa

SEQ ID NO: 18216 - DNA, 291 bp, Homo sapiens
gagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaaggtaaatggcacagatcctga

SEQ ID NO: 18217 - DNA, 191 bp, Homo sapiens
ccacctgggaggataaggcggaagggttgctcgaggctgcagtgaactgtgaatgcaccactgcattccagcctaggccatagaacaggatcttgtctataaataaagaaataagtaaaaatataaataaaaataagtaaaaagaaatataagtaaatataaatataaatacatataaataaaaaaaaaaa

SEQ ID NO: 18218 - DNA, 219 bp, Homo sapiens
caatacagagagctagcaccttattttttagagtggcattgacccaagtccacccaaatataaaataatactcccttctcaaccgaatcccttggcaggaacggtaaggtcagatgccaatgaaccatgtagtcctcactccctaagataatgtgtatttggtctttactctgacaagccaacacattgttctttctgttgttttccaaacaattttct

SEQ ID NO: 18219 - DNA, 370 bp, Homo sapiens
tctctacaatggcgacttagacaaaagtataagattcatagactctatatttgtatgacatacagctaggacaaacatagatatgacattgtgctgctcagtgtaagcaattggaaatatttataagttatatgaaagcctgttttgggctgaaagaatgatttagaaaactagtgataccaaataagtatattcagtcaataattattttcaatgatgaatcacttagtgtgaaagacttgccttgggtattctttatgtaatacaaatcactgtcaattttatggggagctcatagtatttaaatatttaataaacatggacctcttggttttttaatcttaggaacttaaattctacaataatttaa

SEQ ID NO: 18220 - DNA, 314 bp, Homo sapiens
  misc_feature 31: n = A,T,C or G
gaaactcctgggccgcgtgaaggccttcganaggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgctgtctgttgacagaactcactcctctgtcctatgaagaccgctgcattggtgttgagaataataaagctctgtgtttttttccaaaaaaaaaaaaaaaa

SEQ ID NO: 18221 - DNA, 301 bp, Homo sapiens
gataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtaggttggtgtttaaaataatgtaatcatcaaaatgatgcatattgttacactactattaactaggcttcagtatatcagtgtttatttcattgtgt

SEQ ID NO: 18222 - DNA, 303 bp, Homo sapiens
ggaggttagcatacgtatcaaggacagcaactaccatggctcccgaagttttgccaaaacctcggatgcgtgccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaattctcaggttgaattacctagaag

SEQ ID NO: 18223 - DNA, 391 bp, Homo sapiens
gtaacggaaagtgtattctgtacataatttacaaataaaacattttattttaattgttacttattatttagatattctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgtcattttgatttattttaaatctttacattcagaaatgagatactgtattaccagaccaggaggcattgctgtgaaagataatttcctattctaaaatatcaaaaaaaaaaaaaaaaaaaaa

SEQ ID NO: 18224 - DNA, 280 bp, Homo sapiens
cagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggc

SEQ ID NO: 18225 - DNA, 302 bp, Homo sapiens
  misc_feature 54, 110, 129, 210, 237: n = A,T,C or G
acaaccctaaagttcaggcatttctggcagcgaacactttcaccattacagggnatgctgagacgaagcagctgacagaaatgctacccagcatcttaaaccagcttggngcggataggtctgactagnttaaggagactggccgaagctctgcccaaacaatctgtggatggaaaagcaccacttgctactggagaggatgatgatgangaagttccagatcttgtggagaatttngatgaggcttccaagaatgaggcaaactgaattgagcaacttctgaagataaaacctgaagaagt

SEQ ID NO: 18226 - DNA, 162 bp, Homo sapiens
ttgaatatctattgtgtgtgagttgctttctaaatgtaccttaatccttacaaacctggaggaaaaaaatgtttttgaccctgttttacaagttcgtgaactgaaatttacataggtattttttgtatgcccaagccatactgccaatgtcagaactagaac

SEQ ID NO: 18227 - DNA, 299 bp, Homo sapiens
  misc_feature 23, 26, 29, 30, 200: n = A,T,C or G
cgggacaagctcaataacttagnctngtnngacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagnaatttacaccagaaataccaagggtggagatgctccagctgctggtgaagatgcatgaataggtccaaccagctgtacatttggaaaaataaaacttta

SEQ ID NO: 18228 - DNA, 170 bp, Homo sapiens
gaggcacggtaccccttgtcagttattgtgaatatgtggattttaagcaataagattcagctggcagacttttctgggcagtctcagtgacgcatttcctgtgctgtgattgttctgaagacagagtggctctaaccactgtgagaagcccaaataaaaattgatccgaa

SEQ ID NO: 18229 - DNA, 510 bp, Homo sapiens
tattaagaaagacaaaaggactatcacaacgaaggagatttgtttacctgtaagaatgccctgtgaacaaagtacaaatctatgcaaatgcttgtaaaatcttgatgaattattttctaagaaaggataaattacagaaattgactcaaaaaaagtacaaaacctgaataaatcaatatctgcggcaaaaatttttaaaggcatcaaagaactatacttttaaataacagcatgtctagaaaatttttgagagaattatctcatgcttgtgtacttgttataccgacaagtaattcttatgctatttcagaaatacagaacatataaaaagatgaaaatcctcccaaattgttttgtgaagttaacataatcttgatgaaaagtagctcacaacaaaagaacatggccaaattcacctgtgaatttgggtgcaaaaatcctaaatcaaagagaattaattcagaacttttcaaaagtttgttcagaaatgtgcaggataatttttattag

SEQ ID NO: 18230 - DNA, 300 bp, Homo sapiens
aagttcctctagtttactaagtgaaaatttaccaaatgccagaagctcaatccagctgtctactgatccatgcatctcagaggcaccatcgggatgccaaccaaaggaagataagtgttcttttacaagctgcagttctgacttcgtttttggagaaaacgtggtagaaagagttttgggcactcaaaaacttactcagcctccacttcaaaatctttcatatgccaaggaaaaaacattcaaatctgttctgaaattccctaatgctgttcaaattcagactcgattgaaaacatatcc

SEQ ID NO: 18231 - DNA, 301 bp, Homo sapiens
taaataaacactatattgactacacaaaacaatactatctggtaacgatttaaaaatatatgtagaattgaaatatacaaaaacagtaacccaaagaatgtgtgtgtgtaggcacatgaatggaattagagcctgaggttcttgccttgtgtagaaagtagtaaaagtacatttatgcactgcacaatgtttcaatcaatgacagactacatatacaatggtggtctataagatgatgatactgtatttttactgtactttttctgtttagagatacacaaatgctaatcattgtgtacag

SEQ ID NO: 18232 - DNA, 310 bp, Homo sapiens
ctgaaaactgcagcttccttctcaccttgaagaattttcctagaaaactcacaaaatgtgtgatgcttttgtaggtacctggaaacttgtctccagtgaaaactttgatgattatatgaaagaagtaggagtgggctttgccaccaggaaagtggctggcatggcaaacctaacatgatcatcagtgtgaatggggatgtgatcaccattaaatctgaaagtacctttaaaaatactgagatttccttcatactgggccaggaatttgacgaagtcactgcagatgacaggaaagcaagagcaccataac

SEQ ID NO: 18233 - DNA, 162 bp, Homo sapiens
taggaaaagagaaatcacactcaaaggaattagagaaagggtataaaaataagaccagaaatcagtgcaatataaagcagacattgaacaaagaaatcaactaagccaaaagttagttccttgagaagataacacaaaaaaaaaaaaaaaaaaaaaaaaaaa

SEQ ID NO: 18234 - DNA, 340 bp, Homo sapiens
  misc_feature 207: n = A,T,C or G
gatcttgtattctcacctggtagaagcacatgatgctaagattcaccttgtcagggtagtgtcaacagggccagtggcatgcttgaacatatactcccactcagcagtgacaagactcaaggcaagtgtaaggcaaggctagtgaggcgaggctagttgacaacactaggctttaaacacctactatcccatgttaacagaacccgntggggaactgatcctacatccatgaggcggaaggaggtggaggctagtaaggttagttggcaccttgattttccatcatctctttgattcagtggagagctgcttctgactccataatgtaggaacaaagagg

SEQ ID NO: 18235 - DNA, 181 bp, Homo sapiens
atgatgagatgaaatgacgaaatgatgagatgagatgatgagatgaaattttgagatgaaatggtgagtagaaatgatgagatgaaatgatgagacgaaatgacaaaattgaaaagaaattgaagggagaggagatgagataaaatgagatgaaatgagatgatggatgaaatgagatgaa

SEQ ID NO: 18236 - DNA, 460 bp, Homo sapiens
ttcattatataaattacaaatcattcatatgataggatattgtacagccattgacaagaataggctagccttccttagctaacatgaaaacagtctaatgttgttaaatgttaaaagaaggcacagaacagtcaatatagtattattgtttttaactttattatgtgcttatgtatatgaaatgtactcataggaagaaatataaaaatatagcatagtataaatatttattatttctgagagtgagattggaaaagcttttgctttctaagttatacttttccaattttttaacaggaagcttgaattagttttaaatcagaaaaataaagaaaaaatcagtatattcattaaaatttacctcttcaaaactgcatcaagataataaaaatggctggcatggaagatgacacctgtaatcctggcatttggggaggctggagacaggggggatcacttg

SEQ ID NO: 18237 - DNA, 310 bp, Homo sapiens
cagttatcatttgacagattcttatctgtactagaattcagatatgtcagttttctgcaaaactcactcttgttcaagactagctaatttatttttttgcatcttagttatttttaaaaacaaattcttcaagtatgaagactaaatgtggataactaatattatccttattggtcctattgatcttaagggatttacatgtatgtggaaaaacaaaacacttactagaatctctaataaggttatggttagcttaaagagcccctttgttttttattatcagatgggcacctattggatgaagcatatg

SEQ ID NO: 18238 - DNA, 165 bp, Homo sapiens
aggaaaacactgaatgaataggaaggcatttacttggtgattagtaaagcttcatttgaagaacttggcagctagagttatctctgctcgttcctttctgtcttcaatgcaagtacacaataaagctcttattttagaaataattagtattacagttttatagtc

SEQ ID NO: 18239 - DNA, 400 bp, Homo sapiens
tataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgtttggtttttgatgggagggaaagagtactgaaatgttttgtaaattttttttaatgtgctgctaggttttttgttttgttttggtctgaagagaagagtggtaccatatgtgcaggaagtcaaactggacttttggggctactaaattgcctttaatcttatggtctcaa

SEQ ID NO: 18240 - DNA, 300 bp, Homo sapiens
cagattgtataagcaaaggctattattgctgctgtgttatagtcactttggtggtggtggtagcaggctagagagaatctcctttgccctgaagtctagaatgtaaatttgtaccaccaaacacaatagccaatattataaacaggaagtaagaaaaaaacctcatctcacttgcaaaagatcagcttattttcaattgtggaaattaatttgttatagataacagtagatttgagtgactttatttacttttcctcttcagtataaaaaataatattagtataatctcattacatcaat

SEQ ID NO: 18241 - DNA, 179 bp, Homo sapiens
gaaagataagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggagg

SEQ ID NO: 18242 - DNA, 305 bp, Homo sapiens
gaagtattcaataccgctcagtattttaaatgaagtgattctaagatttggttgggatcaataggaaagcatatgcagccaaccaagatgcaaatgttttgaaatgatatgaccaaaattttaagtaggaaagtcacccaaacacttctgctttcacttaagtgctggcccgcaatactgtaggaacaagcatgatcttgttactgtgatattttaaatatccacagtactcactttttccaaatgatcctagtaattgcctagaaatatctttctcttacctggtatttatcaatttttcccag

SEQ ID NO: 18243 - DNA, 329 bp, Homo sapiens
ctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttctgtgtgcaaaatactgagtaaccactgggaaaatatttcagatgaaagggatgacaaaagcatgttgcgctttgcatcagcaaggcattgacttctgaaaaaatgatctgaaaaaagtttcaccgtt

SEQ ID NO: 18244 - DNA, 300 bp, Homo sapiens
  misc_feature 246: n = A,T,C or G
gatgtgtatggaaagcttgcagaagattatgccagcggaggctaagaacagagtcatttttgaactaatttatgaatatgaaagaaggaaacatgaagagctttctataaatagcaatccagtgtcttctcagaaacaaccagccttgaaggctacaagtggcaaggaagattctatctcgaatatagccacagaaataaagggtggacaaaaatctgggacagtgtcttctcagaaacaaccggncttgaaggatcaagtgacaagaacgattctgtttcgaacacagccacagaaata

SEQ ID NO: 18245 - DNA, 300 bp, Homo sapiens
ctgagaagagttgagggaaagtgctgctgctgggctgcagacgcgatggataacgtgcagccgaaaataaaacatcgccccttctgcttcagtgtgaaaggcacgtgaagatgctgcggtggcactaactgtgacatctatgaccttttttatcatcgcacaagcccctgaaccatatattggtatcactggatttgaagcaccgtatcttattttcatacttttatatgactcagacttgacgaataatgaaggggtattttggccttgcttgggttgcacttgtgacaacaggatgct

SEQ ID NO: 18246 - DNA, 376 bp, Homo sapiens
gaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaa

SEQ ID NO: 18247 - DNA, 300 bp, Homo sapiens
  misc_feature 253, 291: n = A,T,C or G
cattgctgctgcaatctaaataaaacttacgacattttaagatattcatagcaaaccaacaaaaatatatgtttttactttaaagggaatgtttttctcttcagctgactaaaaatgaaagcaaaatatcttatgtagaaatatttgataatattttacagtgagcttcccatggtttttatgtctaaggttcttgctgcggttatgtaggttgcacaagaccttttactcacttggaattgggcctcaaaanttttggaaggctacctttaaattgccccgacgattagnatctacaag

SEQ ID NO: 18248 - DNA, 302 bp, Homo sapiens
caagactgggaaggttactttggattacagacctgttattgacaagaccttgaatgaggctgactgtgctactgtacctcctgctatccgttcctactgaaaaacctgacagctacaggaccagcttatgtgattatacatcatagcttacctaggtttcctttcatactcgtcttgttaaaaatctgctctcatgaacaaggagtcacttcacagattatgatcaacagcttggcagtacttgatgtgagggactcgagttgcaccattgtctctcattcttgtgcagtgataaactggta

SEQ ID NO: 18249 - DNA, 259 bp, Homo sapiens
ggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatt

SEQ ID NO: 18250 - DNA, 470 bp, Homo sapiens
  misc_feature 127, 314, 346: n = A,T,C or G
ctaaatttacatcttcaatccagacttctcacctgcctaatggccttatattttcagatacctagaaggtatcaccttttatctcattttctcaaatttaaatatccaaagtaaaactcaaaatgtngatattcattttctctctctgcctctgccatcctctctaccaccctaaagtcccaacattccccattctccatttagcaaataaagatagtagaaagaagtgttttattaagcattgataagtagcaaaagatagaataatttctattgttggtaaatgaaagataagggaaggaatgacacatttnatataacgcttattaggaaagaaatgtgctgnagtccaagtaatatgaaatattattaattttaatatttcattcaccaaacaccaatcatttttacaggggataaatttggggaaaggttagggcaaggttaaatttttgggaaaaaataggggc

SEQ ID NO: 18251 - DNA, 310 bp, Homo sapiens
tgcccctgttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggggctttgatggtctcatgccatcagttgtgtggaaatgtatgatccaactagaaatgaatggaagaggatgggaaatatgactcaccaaggagcaatgct

SEQ ID NO: 18252 - DNA, 392 bp, Homo sapiens
gccagaactgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatgaccaaatcggtcatccgcactgcccttgggactgccgaagtgaaccattccaccagaacctttgattctgcacaagatttccttgctctgggaacaacccccaaatgcccttgggaggaacaatatgagctcaggaagcctctctttcttcacttaccattactaactctccaagcatagaaat

SEQ ID NO: 18253 - DNA, 450 bp, Homo sapiens
aatttgacttcctcttttcctaattgattaccctttatttctttctcctgcctgattgccctggccagaacttccaacactatgttgaataggagtggtgagagagggcatccctgtcttgtaccacttttcaaagggaatgcttctagtttttgcccattcagtatgatattggctgtgggtttgtcgtaaacaaagacacaacataccagaatctgtgggacacattcaaagcagtgtgtagatggaaatttatagcactgaatgcccacaagataaagcaggaaagatctaaaattgacaccctaacatcacaattaaaagactagagaagcaagagcaaacacattcaaaagctagcagaaggcaagaaataactatgatcagagctgaactggaagggaattagagacataaaaaacccttcaaaaaatcaatgaatccatgagc

SEQ ID NO: 18254 - DNA, 500 bp, Homo sapiens
  misc_feature 7, 402, 435, 447, 466, 478, 483: n = A,T,C or G
gtataanaacaatatctctgtagatggaccaagtgacttctgcccacctggacacaacaccaaaaaggcttcttattcgggtgtgagtcttttcagcaacccggccagtactgggagatacagccatccaccttcagatgtgtctacgtgcgctctgcattcaactcggaaactataagtaattctcaagaaagccctcatttttataacctgcaaaatcttgttaatgcattgctaaaaaataaataaaagctagatactggaaacctaactgcaatggggatgttttacccacatgacttattatgcataaagccaaatttccagtttaagtaattgcctacaataaaaagaaattttgcctgccatttcagaatcatcttttgagcttctgtggatgtnaactgactactagagatttcttattcactaaangaaaattggagnaatatatatgcaaattagnaagctttctttntaatncaggaaaataaaagggt

SEQ ID NO: 18255 - DNA, 300 bp, Homo sapiens
tatttctggatgctaagcccattcagtccaccatatccagctcgcagaattactgaagttcggggcattccttcccccattgatactgtttctactaggtgcaactgtgaaggaaaaactttcttctttaaggatcctcagtactggcgttttaccaatgatataaaagatgcagggtaccccaaaccaattttcaaaggatttggaggactaactggcaaatagtggcacgcgctttcaacagctgaatataagaactggcccgaatctgtgtattctgtcaagagaggggcagcccca

SEQ ID NO: 18256 - DNA, 300 bp, Homo sapiens
  misc_feature 38: n = A,T,C or G
tctcagttcaagaaacataaacatctgtatgtaggatnttaggttttgcaaatggtgataggatgctaccacaaaacctaatggataacttatcctaagctaggattttatgggacaggaataatgaagatacaactaagaaaactcatggttgagtggtttcttctctctgaactattttattaatatagtactattttaaattatgaaatgtagaggaaaccattatccttagctttttcctaccctctccagtcacctccttcattgagaagggcatattaggcatccatctggata

SEQ ID NO: 18257 - DNA, 242 bp, Homo sapiens
accattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttt

SEQ ID NO: 18258 - DNA, 330 bp, Homo sapiens
  misc_feature 13, 220, 249, 274, 310: n = A,T,C or G
aactttatatttnatactctaaaggcggcaagccaatctgcatttcctctagtggaaactgtatagctggcatctttccaggacccttttatcaagaaacaatgcagcttctacatttgtgctgcttctacaccaaaacagctggaatgtatatagtatggtctggatgctcttgtatacctcactcttcatttctcacctaacccatgtgctatgattngaatgtttctcccctgcaaaactcatgtngaaatgtaattgccatgataacagnattaatagggtggaatatttaagaggtgattagggnggggtgggagatgtataaaa

SEQ ID NO: 18259 - DNA, 300 bp, Homo sapiens
  misc_feature 36, 159: n = A,T,C or G
tccaaccgactacttcagaggaaacaaatggtcatngatgtccttcaccccgggaaggcgacagtgcctaagacagaaattcgggaaaaactagccaaaatgtacaagaccacaccggatgtcatctttgtatttggattcagaactcattttggtggnggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacaga

SEQ ID NO: 18260 - DNA, 376 bp, Homo sapiens
gtgcagtaagcttcaggatagctctgttgacagcagggcatttagagagtcccaagtatagtcatgtatcactggggagggaagaatctttgaggacatctagtttacaatctttattatttttcaggtgtagaaaagagattaaagatcatagaagtcagaataaatttgtaaaagttctcatagtcaaaacagctaagtaatggcattgccagactccaaaatcctgaccagaatataaatcaccaattgttggtttaaaggggttatttgtgaatcattttccaaaaaaagaagtacactttttgtgttacttaccatttcaaagaaacttattcttcaagaccatttcagatttccttaggaatgtatgtgt

SEQ ID NO: 18261 - DNA, 315 bp, Homo sapiens
  misc_feature 47, 53, 87: n = A,T,C or G
ctttgaaatctaacttgaattttaagcaataagaggccaggggcggnggcttntgcctgtaatcccagcactttgggaggccaaggngggtggattacctgaggtcaggagtttgagaccagcctggccaacatggtaaaacaccatctttactaaaaatacaaaaattagccaggcatggttgtgcacgcctataaccccagctactcaggaggctgaggcaggagaatcgctggaacctaggaggtggaggttgcagtgagctgagattgtgccactgcactccagcctgggtgacagagcgagactctgtct

SEQ ID NO: 18262 - DNA, 248 bp, Homo sapiens
ccaatctttcctactttctatttttatgatgacaatcaaagccggcctgagaaacactatttgtgactttttaaacgattagtgatgtccttaaaatgtggtctgccaatctgtacaaaatggcctatttttgtgaagagggcataagataaaatgatggtatacatcaatatgtatatatgtatttctatatagacttggagaatactgccaaaacatttatgacaagctgtatcactgccttcgtt

SEQ ID NO: 18263 - DNA, 400 bp, Homo sapiens
  misc_feature 27, 252, 339, 384: n = A,T,C or G
tgactgaaggagtgggagagctcgtgngagttttgggtgtatcaggccagaatatgtaattttccatttccctgaaaaagacttcagaggaaatttattttccccactatacgctccagaatgtctttcggtgaaatgagagggcttgggctcttctgattctagacgtagctatcagagtttgcttaatgaaatatgggtctactcacaaataaagcaatttaatggtttcgaaagagtaggcaacttggnggttcattaccatttctgtcatttgagaaaaatcataaaattacagaaaaggaaacattcattcaaaaataagctttgaatttaganggaaggcatatatgtttaatttcacatgacttcaggggaggaagncaaaatggaggaaaca

SEQ ID NO: 18264 - DNA, 300 bp, Homo sapiens
tactctcatttaggaaacttgctaccatgctgctgtcccttcaggctcacatgcacaggaatgctacatgaaggccagctgcttccctccttggctatcatccactgcagctgctagttagaaaggtttggagggatgacttttagtaaatcatggggattggattgattaattttcacttttgggattttgtggggtgggaagtggggaacaggaaaagccctcgacttgactttcaatcatctctgctaatgaaaaagggtctttctctcgggggaaaaggggggcaagtctgcaagc

SEQ ID NO: 18265 - DNA, 366 bp, Homo sapiens
ataaaatagaataattcttttctgaggatagtagttaaataactgtgtggcagttaattggatgttcactgccagttgtcttatgtgaaaaattaacttttttgtggcaattagtgcgacagtttccaaattgccctatgctgtgctccatatttgatttctaattgtaagtgaagttaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttg

SEQ ID NO: 18266 - DNA, 410 bp, Homo sapiens
  misc_feature 44, 123, 226, 258, 265, 282, 312, 329, 379, 389, 406: n = A,T,C or G
tttttaacgtaattttaatagcttaagattttaagagaaaatangaagacttagaagagtagcatgaggaaggaaaagataaaaggtttctaaaacatgacggaggttgagatgaagcttctncatggagtaaaaaatgtatttaaaagaaaattgagagaaaggactacagagccccgaattaataccaatggaagggcaatgcttttaggattaaaatgaaggngacttaaacagcttaaaggttaggttaaaagntggaggngattaaaataattgganggcgatcttttaaaaagagattaaaccganggggattaaaagacctngaatccatgacgcaggggagaattgcggcattttaaagcctagttacgcntttactaacngcagacgaaaatggaangatt

SEQ ID NO: 18267 - DNA, 217 bp, Homo sapiens
  misc_feature 8, 84, 104, 106, 176: n = A,T,C or G
tctgctgngtcacttgctatgtgcttccacccgcgccgggagtcccactggtctagaacccggctctgagggcactggcctagntcccgacttgtttctcaggngngaatcaacttcttgggccttggctctgagttggaaaaggttttagaaaaagtgaagagctggaatgtggnggaaaataaaaagctttttttgcccaaaaaaaaaaaaaaaa

SEQ ID NO: 18268 - DNA, 119 bp, Homo sapiens
tcagagcattgtgcaatacagtttcattaactccttcccccgctcccccaaaaatttgaattttttttcaacactcttacacctgttatggaaaatgtcaacctttgtaagaaaaccga

SEQ ID NO: 18269 - DNA, 420 bp, Homo sapiens
  misc_feature 29, 262, 330, 358, 390, 402, 409: n = A,T,C or G
agacaaagttaatacttcagtaacaactntaggaaaattccagattatgtattatacagtatcatattgtggggataggtgaacatctatagtatatggccagggctttcctttcccctaaattttgggagaaatttattacatggatactttacaaggggtattgtgttatctggaagatggtaacttggagtatggttatagaaaatatagaagggggggatttctgtcatgtcacccctcagacacatgccaggtgggncttaagcagaaaactagattaagaccaagaggaaataataatacttcaggaagctaaaacccccaggngttaaacaaaggttttcaaaaatacatngggttgctccaattcattcctccaccatgctnttcaggaggaanccttttnaaaaaatggcg

SEQ ID NO: 18270 - DNA, 242 bp, Homo sapiens
  misc_feature 20, 21, 40, 46, 61, 81, 85, 91, 101, 166, 184, 189, 202: n = A,T,C or G
agccttgacttgagaccagnntgaccaagaccagcctgancaacanggtgaaaccccatcnctactaaaaatacaaaaatnagcngtgcgnggaggagccngctgtaatcccagctactcaggaggctgaggcaaggagactctcttgaacccgggagcggagatnggggtgagccgagatcanggcantgcactccagccngggcaacaacagcgaaactccttctcaaagaaaaaaaaaa

SEQ ID NO: 18271 - DNA, 310 bp, Homo sapiens
atcaagaggctatacaatatgaggaagatgataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatggtaaagcctcttcccttgaaattaaaaaaaaa

SEQ ID NO: 18272 - DNA, 270 bp, Homo sapiens
  misc_feature 138, 144, 171, 201, 212, 229, 252: n = A,T,C or G
aaatcttctgccatagcgactgcatttgcctccagacttgtcagacacagtgagccgctcaagcaaaatggatctggcagaatccgccaagcggctgggcccaggctgtggcatgatggccggaggcaagaagcaccnggactnctagggattcctccttagtcgctgcangcagaattctatgacactctaattatgatngctaatagctnatgtaaatatttttctnaacaatttgaccctccactcctngaaaaacacaggattata

SEQ ID NO: 18273 - DNA, 320 bp, Homo sapiens
cagaattctgtgattcagtgaaagtgttcttgaagagtaaagttgaaaggatgacatctgttaataaaacactaagagaatttgttgccagcacatctgtaccacagaaatgttaagagaagttcttcaggctgataggagggaaaaccagatggaaactcagatcttcaggacagaatgaagagcatcggaaatgggaaataatttgggagaacatttcagaagtaataaggatataagaaaatttgagcggcacaatccataagcttatgaatttgttgttcccagcaattggagaatacacattctttgcagtcaca

SEQ ID NO: 18274 - DNA, 178 bp, Homo sapiens
  misc_feature 33, 37: n = A,T,C or G
aaccctctaaatccccttgtaaatttaactgtnaggnccaaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaa

SEQ ID NO: 18275 - DNA, 499 bp, Homo sapiens
acaggaggacttacaaagagtgggggttttattggggtgggaattagggggcgattcggatttttagatttttcatatcttttatggggtccaatgaagcagaaaatttaaatgaagttattacctttgcctgatttttgacacacctcaaactataacttgaggttgctaactatgaaacactggcatttaatgatttaaagtaaagaattctgtaatttgtagacttctgagaagttccagaaaataaatcagatggtatgtaacagcgccgtgtgctcaaaagaagtgctgaaggaagcaccctcctaaccctgaaaaactacgctttgtattgaaggatcagatgaagcagatgggaagtaacatctccaggagagtccaaatttcagcagaactggcagaaatgcttctctcgaccacgagtgccaagcagaaaatgaatgatagcctgggtccctcaaacaaggaagagaaatggggatctcaggacctgggt

SEQ ID NO: 18276 - DNA, 362 bp, Homo sapiens
atgaatgaatgaaagaatggttctaattcacagaggtctattaggctgtgtttacaaacatgacattggatggatttgaaatgcagtgtaagctttacagggttgcttttccaattatttcccatgcaaccagcaggctgtgtggaattggttgtggacactataagtaatatagatcagagattatatttgtagaagcagaagctcttttcactcaattaaaaattaatcaaacatgtaaattctttattataactcttttacaccattttactgataagatatacacaaagcaagatttaaggagaaatctaaaggaagcataatattatttataaactcttcttagacattattaaata

SEQ ID NO: 18277 - DNA, 290 bp, Homo sapiens
  misc_feature 29, 38, 39: n = A,T,C or G
aaagcgagctcatcttcaactcctgatgnatcactagnnttaaaatgtgggccagcaagccctcaagtattcttgatatttttcctcatatgaggcataatttattactcatgaatttgtattttattcctggggccttctactgcttttacaaatgttgacatttattccaacagcaacaagtgatcgtattctggattctatcccacctaaaacttctagaactcttgaacagccaagggcaacactggggtaatgtttttaacagaaaaatcatactttattttcca

SEQ ID NO: 18278 - DNA, 320 bp, Homo sapiens
  misc_feature 15, 163: n = A,T,C or G
tctctcctttccagncggagacctctgccgcaaacatgctccgcagatcatcggtcaggccaagaagcatccgagcttgatccccctctttgtatttattggaactggagctactggagcaacactgtatctcttgcgtctggcattgttcaatccagatgtntgttgggacagaaataacccagagccctggaacaaactgggtcccaatgatcaatacaagttctactcagtgaatgtggattacagcaagctgaagaaggacgtcagatttctaaatgaaatgttcactataacgctgctttagaatgaaggcttcc

SEQ ID NO: 18279 - DNA, 308 bp, Homo sapiens
cacatctttgtttgaaaggcttgtcaatttcatattccttgaattggcttcttggtgaggattttctgacagagtgatacccatcaattttctatccttagacaatgtagtgtgaagttcacagttgacaaacaacaattaatgtttcccttggatgttttgacaaaaataaacctcatcattgttatcaccagagtgccctctaccttactttaatgcagattttataaattttacctcatttagaacataaaataattattgaaagaaaaatgtattttttaaattcaccgtgattgaactgtaaa

SEQ ID NO: 18280 - DNA, 300 bp, Homo sapiens
  misc_feature 203, 208, 227, 236, 237, 294, 295: n = A,T,C or G
acacatgccttgcaggcatgagcaaagaaaatgtgctaaacaaaactacagtcagaatcatagaaaggataaggttttagagaggttttgttgttttttaaacattcatgtgagctaaatataatgcaggtattgaaatgattactgcagatatgccagatgaccttgatatctattttaatggtaatcttctggtatttggnggtgntgaattggtacccccacgntttacctgnnaagggaattgaaatatttcaaggccagatcagggcttacgcatgtaatttcagcagnntggaa

SEQ ID NO: 18281 - DNA, 420 bp, Homo sapiens
agaaaataattccttatctgttgggccatagctctttcctttcttgagcccctgacgaagtattatctagttcatgaaggctttcctcattattgttttctatttgtgcccatttcatttgcttagttaattattatacatgaactgaccattttaggtttcttgagagatgttgagggagcacagaaggccaatcccacctcacttcccttagttcacagcaaacaagccaaatctttgcgtttctacatatgatttgggcaatgcccttcactatgcatacaacagaatgaacaatagtgcctgtggacatttacttatattcatataagactttgggatattctgacctaaaggcttaggcatcctaaacatttcaggaggactttaaagatgccagggggaggaataatttttttt

SEQ ID NO: 18282 - DNA, 360 bp, Homo sapiens
  misc_feature 26: n = A,T,C or G
ttttctacaaagtattttccaggatnttacccacatttaaacaatgtaaaattctttgtttcctgcaacaacttacaaaataaggtaaaagactaaaattcaagatttgcttccttcattgtcctaagacgattcgttgagaatcactgactttgagatatttaaaactttcagcattatactgtggtttcttttgcactgcactcacctattcaggactcctcccccaggttcctcatcatgcacaaaaatgcaaagaaaacatcttattagtaattaatgaagcaacattgaaattctaactctagctgctttgggattctaattaactcagcatcaatttctcacctcagactacag

SEQ ID NO: 18283 - DNA, 281 bp, Homo sapiens
  misc_feature 23, 29, 99, 266: n = A,T,C or G
gggacacacttagctggagatgnctctanaagccctgtatcgtattcaccttcagtttttgtgttttgggacaattactttagaaaataagtaggtcgntttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtataccgttncaaaaacaccccccc

SEQ ID NO: 18284 - DNA, 350 bp, Homo sapiens
  misc_feature 41: n = A,T,C or G
tatttaaaaatgcccaaaacacaaaaatagacttttaaggnaataatatatattactaaatatattatagtctacttataataattatatcgtcgttttcaatattacaaaaaggaagaaaaatacaagggaagcagacgacccaatatatataaatactataaaatcatattagaataaataaagtcgtcataaataaagggcccattgatttatgggtggggtttgggaacggctttggctacttgcttttggagggtaatttgagcaccaggattccccctcaggagaggttccagttaccaggagacactggaaccttaggtctataaaaactggaggggcagtga

SEQ ID NO: 18285 - DNA, 448 bp, Homo sapiens
ttgcgtcttgtagaaagattatattggcgcttgatccgagatacactggatgtaaattcaggtggattaaagacctaaatgttgctttaaaaaaaaaccatacagggccgggcacatggctcatgcctataatcccagcactttgggaggccaagacaggagttttgtttgagcccagcctgtgcagcatagagagacccccaactctacaaaaataaactaaaattaaccaggcgtagtggcatgcacctgtagtcccagctactcaagaggctggggtgggaaagatcacttgaaaccggagttcaaagctgcagtgaagctgtgattgcgcggtgcattccagcttgggggacagggtgagaccctgctcaaaaaaaaacaaccaaaaaaaactatttaatttggtgtggaaatatagggaaatatatttttgactttgggggag

SEQ ID NO: 18286 - DNA, 305 bp, Homo sapiens
aacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgtcactttttata

SEQ ID NO: 18287 - DNA, 310 bp, Homo sapiens
gctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctaga

SEQ ID NO: 18288 - DNA, 145 bp, Homo sapiens
cactaaggtggtggccacaggacagagtgtaagggatgggagcatacacaccatgtgggacctaactagacagcagaaatgaaagagaagaaagattaataaaggaaaaggactcaggtttccagatgaggtcaatagcattcca

SEQ ID NO: 18289 - DNA, 551 bp, Homo sapiens
gaagattagggatcaaaactcattcgaaaagctaaagagtaccattcgtacccgttggaatagcgggttttgcagcaattgttgcatatggattatataaactgaagagcaggggaaatactaaaatgtccattcatctgatccacatgcgtgtggcagcccaaggctttgttgtgggagcaatgactgttggtatgggctattccatgtatcgggaattctgggcaaaacctaagccttagaagaagagatgctgcttggcttgttggaggagcttgctttagttagatgtcttattattaaagtacctattattgtggaaataaactaattggatgggttagatggaacatggcatttgaatattggcttccttctgcagcttgattgcttggtggccgaatactagggctagtttactaactaggcattcaaggaagcaagttaacttaacatggcacctaaatgcccttgaggggtggaaaggccaccttcttaaattttaaaaagaacttagtctaaagaaaaaacaggccaatcctgaagggcct

SEQ ID NO: 18290 - DNA, 378 bp, Homo sapiens
tgtgttttggaagcagaaaataaaaaactagtagaagaccaggagaaactggaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaattttttttaatgccacacataggttgtattgtaatggcattatcaaaatatttgatg

SEQ ID NO: 18291 - DNA, 310 bp, Homo sapiens
  misc_feature 250: n = A,T,C or G
attaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtnactgtacacttgtataagtaccgtttacttcatggcatgaataaatggatctgtgagatg

SEQ ID NO: 18292 - DNA, 245 bp, Homo sapiens
ctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacc

SEQ ID NO: 18293 - DNA, 400 bp, Homo sapiens
  misc_feature 69, 72, 74, 251: n = A,T,C or G
ctcagtcactcgtaggactctgcactgaatggctgacctgacctgaagtccatgtcatcccaccctgcncanantgttgatacatgactgtttccatagtacttatgtttttaaaaatattcagtcatttcctactataatcctcatgtatccatgtaactgactcaaaaatacttcagccatagaaagctaaaactgagcaaatctcattcttcttttccatcccctttgcatgtggctgggcatttagnaatgattaataatatggccagctgaataacagaggtttgagacacaattctttctcaaaggagcaggctaagctgggctacttatggcaaacatctaaatgtggggaagatctgatatttgacaatggaaaattccacttagctagcta

SEQ ID NO: 18294 - DNA, 302 bp, Homo sapiens
acaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagcagctaa

SEQ ID NO: 18295 - DNA, 146 bp, Homo sapiens
tcattctaacctgaatcggaggacaaccaggaagctacccttttaccgtcattggacaagtagcatccgtactatacttcacaacaatcctaatcctaataccaattatctccctaattgaaaacaaaatactcaaatgggccaaa

SEQ ID NO: 18296 - DNA, 280 bp, Homo sapiens
atgccccactaatttttttgtatttttagtagaaatggggttttgttatatgggctaggctggctcaaactcctggcctcaagtgatccgcctgcctcagcccccctaagtgttgggattacaggcgtgaatcacctggccagcagggcaggactttcctaaggcttctctgaactcgtacttgtaaatcctctaccctacaagactttctgcaaccctaacactaacatcttaagggtgaagtaaaaaaataataataaataaataactaattaaaaaa

SEQ ID NO: 18297 - DNA, 278 bp, Homo sapiens
aagggtacacatttagaaggagagctgttttgttcggtgactcgaactcactgagaccctgctgaatgtaaaaggctaagttctattcaatttaatttatttgcttgaacctgacagctgtctttcagtttttattgtattcccctttaggctggtcaatttctgacaaatgagaaaaaatatgttaatcactgagtgtttgattattggatgatttgtgtattttagttattgtctagatttggacttgaagataaaatgacctggtaaatttcatg

SEQ ID NO: 18298 - DNA, 323 bp, Homo sapiens
acaggcacatgccaccacacccgctaatttttgtgtttttagtagagacagggtttcaccatgttggccaggctggtctcaaactcctgacctcaagtgatccaccccgctaggcttctcaatgttttgggattacaggcatgagccaccacaactaattcttaagtaccccaagttaatatcctcctgataagtctagttcaacataattagcatagatagtttattatgaaaatatagctgtaacgtctaggatgcccctttcttcagataaataacagtgagaacaatgcagaaggaataatcaaggtactcttaggtag

SEQ ID NO: 18299 - DNA, 300 bp, Homo sapiens
cttaagggcataatggttaaagggtgtggatgaagcaaccgtcattgacattctaactaagcgaaacaatgcacagcgtcaacagatcaaagcagcatatctccaggaaacaggaaagcccctggatgaaacactgaagaaagcccttacaggtcaccttgagggagggttgttttagctctgctaaaaactccagcgcaatttgatgctgatgaacttcgtgctgccatgaagggccttggaactggatgaagatctctaattgagattttggcatcaagaactaacaaaggaaatcag

SEQ ID NO: 18300 - DNA, 360 bp, Homo sapiens
agcactctaggactctgcactgaatggctgacctgacctgatgtccattcatcccaccctctcacagttcggacttttctcccctctctttctaagagacctgaactgggcagactgcaaaataaaatctcggtgttctatttatttactgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaag

SEQ ID NO: 18301 - DNA, 178 bp, Homo sapiens
aaagaaagaaaaagaaagagagacgaaagagagaaagagaaaggaagaaaaagaaagaaagagaaagaaagaaaagaaagaaagaaagaaagaaagaaagaaagaaagaaaagaaagaaagaaagaaagaaagaaagaaagaaagaaagaaagaaagaacgaaaaaaaaaaaaaaaaa

SEQ ID NO: 18302 - DNA, 310 bp, Homo sapiens
aaggcagtgttgaaaggggccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcg

SEQ ID NO: 18303 - DNA, 249 bp, Homo sapiens
  misc_feature 29: n = A,T,C or G
ctgctcatccgggccgtggaagcatcagntcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaa

SEQ ID NO: 18304 - DNA, 300 bp, Homo sapiens
aaggtaaatgaccatgttttcagcaaacagtgacagtttgaattcctctttaccgatttggatgccctttatttctgtctcttgtctgtttgctctgtctaggacttccagtactatgctgaagagaagtgatgggagggggcatccttgtcttgttccagtactcagaaggaatgctttcaacttttccccatttagtattatgttgctgtgggtttgcataaatggcttttattacattgaggatgcccttgatgcgattttgctgaagtttaatcataaacggatctggatttgcga

SEQ ID NO: 18305 - DNA, 358 bp, Homo sapiens
gagctgctttttattagtaagaatcttttggcgaatggtccgaggcggccgagatgcaattttaattttgttgtaaggggggggggggggaattgctggtttcaccatttcagatctgtgttgtctaagagtattaacgttttaattaagcaaagaaatgatttttaatctgtatggaattgttttaaagccccattttaagagaaaatactggcaatgaagaaccagtttaggcatttgctataaactgaaatatccaaaagaatcatctataacagccctggaaattcctttaaaatgatacctaacaggacggttggccaatttttttaaatatacttcctttgggggggcaatt

SEQ ID NO: 18306 - DNA, 390 bp, Homo sapiens
  misc_feature 294: n = A,T,C or G
taaacatttattgtttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggnggaagatattgaggccaagaatattgcaaaatacatgaagcttcatgcacttaaagaagtatttttaggaataagaattgcatacctacctagtga

SEQ ID NO: 18307 - DNA, 300 bp, Homo sapiens
  misc_feature 35, 297: n = A,T,C or G
gtacacctacactaatagtcttgtctcaacaatgnttaaaggaacttaagtattgggttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagnacg

SEQ ID NO: 18308 - DNA, 306 bp, Homo sapiens
cacatattcacagtaggattagatgtagacacacgagcttactttacatcagccactataattatcgcaattcctaccggtgtcaaagtatttagctgacttgcaaccctacacggaggtaatattaaatgatctccagctatactatgagccttaggctttattttcttatttacagttggtggtctaaccggaattgttttatccaactcatcccttgacatcgtgcttcacgatacatactatgtagtagcccatttccactatgttctatcaatgggagcagtgtttgctatcatagcagga

SEQ ID NO: 18309 - DNA, 310 bp, Homo sapiens
  misc_feature 2, 51, 90, 91, 134, 137, 147, 152, 174, 180, 202, 209, 264,282: n = A,T,C or G
anttagaactgaacaaaatgaaagacagtgggtagctggtgatttgcatanggctcaacagtcactggagcttatccagtcaaaaatagnnaaagctgctggagacactgctgttattgaaaatagtgatgctnccncagaaacggngtctnctgagaaggagacaatgtctgnaagtcnaaatcagactgtaacacagttncagcagnacgcttcaggcggtaaaccaacagctcacaaaggagaaagagcactaccaggtgnagagtgaagtaattgggnaagctgttcatttgaggataaaaaaggc

SEQ ID NO: 18310 - DNA, 300 bp, Homo sapiens
  misc_feature 33, 75, 110, 174, 213, 252, 275: n = A,T,C or G
acccgtttcagccacatctaaaagagcacagcntatgtggtgcggaattaaacttccccatcctgcagattatgnggaaatacccaaagataatagtgcatagctccttncagcctctagccttcactcctgggctccaaaagctatcccagttgcctgtttttcaaatgaggncaaggtgctgctttgcatgcctgccaacccatggaaganggagcttacttcttttctctcttatttattaaccatggnctgagagttgtttttgtctatgnaacagtattgccacaaaactatagg

SEQ ID NO: 18311 - DNA, 345 bp, Homo sapiens
catgcgacaagccttatattccaaatggtgactactcacctttaaggattaaacacagaactggagatgaaatcacgtaccagtgtagaaatggtttttatcctgcaacccggggaaatacagccaaatgcacaagtactggctggatacctgctccgagatgtaccttgaaaccttgtgattatccagacattaaacatggaggtctatatcatgagaatatgcgtagaccatactttccagtagctgtagggaaaatattactcctattactgtgatgaacattttgagactccgtcaggaagttactgggatcacattcattgcacacaagatggatggtcg

SEQ ID NO: 18312 - DNA, 466 bp, Homo sapiens
acgggacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcaggtataactgcatttctagttctatatagtgcaatagagcataggattctataaattcttacttgtctaagacaagtaaatctgtgttaaacaagtagtaataaaagttaattcaatct

SEQ ID NO: 18313 - DNA, 301 bp, Homo sapiens
  misc_feature 30: n = A,T,C or G
aagtgccaatcctttgaatgttccacgganacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggcaaatgaaggtgaattcaaggctgaag

SEQ ID NO: 18314 - DNA, 265 bp, Homo sapiens
catattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgt

SEQ ID NO: 18315 - DNA, 480 bp, Homo sapiens
  misc_feature 49: n = A,T,C or G
cgaatttgtaccaatagaagggcactttttttagattaaaatgaaggtngacttaaacagcttaaagtttagtttaaaagttgtaggtgattaaaataatttgaaggcgatcttttaaaaagagattaaaccgaaggggattaaaagaccttgaaatccatgacgcagggagaattgcgtcatttaaagcctagttaacgcatttactaaacgcagacgaaaatggaaagattaattgggagtggtaggatgaaacaattcggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaaggcaaaatgacaaacttagaagaaattggagtagaacag

SEQ ID NO: 18316 - DNA, 444 bp, Homo sapiens
  misc_feature 127, 134, 139, 140, 142, 144, 148, 149, 154, 157, 160, 161,162, 166, 167, 168, 169, 174, 177, 178, 179, 181, 183, 189,190, 198, 199, 200, 202, 206, 208, 213, 214, 216, 217, 220,229, 234, 235, 236, 243, 250, 251, 253, 261, 270, 278: n = A,T,C or G
  misc_feature 280, 282, 283, 285, 305, 309, 310, 312, 313, 315, 320, 322,331, 332, 336, 339, 341, 352, 354, 361, 365, 366, 367, 368,369, 370, 383, 384, 386, 392, 395, 396, 397, 398, 399, 400,407, 408, 409, 410, 411, 412, 413, 414, 415, 416, 417: n = A,T,C or G
  misc_feature 418, 419, 420, 421, 422, 423, 425, 426, 427, 428, 429, 430,431, 432, 433, 434, 435, 436, 437, 438, 439, 440, 441, 442: n = A,T,C or G
gaatggggcaatgtaaagccagaatatcaacgtccttttgtcaagattttcaaacctatttggctgatagtacacttacaagaataggtaaaaaagatcccaaaaaaaaaaaaaaaaaaaaaaaaanctttttnggggnngncngggnnaaaanaanttnnntttnnnnaaaanttnnntntngggggnnttttgggnnncntttngnccaanngnngtnggggggggngggannnaaaaaanggggggnntnccgggaanaaaaaaagngggggggntncnngnaaaaaaaaaaaggggggggntttnnannanaaaananttggggggnntttngananaaaaaaaaaantnggggggntttnnnnnnaaaaaaaaaaaanngngggggnttnnnnnnaaaaaannnnnnnnnnnnnnnnntnnnnnnnnnnnnnnnnnngg

SEQ ID NO: 18317 - DNA, 400 bp, Homo sapiens
ttcgtgttcggtttttctcttccttcgctaacgcctcccggctgtcgtgagcctcccgccggccgtgccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggcattcagtggtgccccaccacaaggatgaccctcctcctctgaagatgatgagaacaaagaaagcgacagatgatatcctgttgggaccaagaattcctgaaagttgaccaaaggaacactttttgaactcatctggctgcaaa

SEQ ID NO: 18318 - DNA, 329 bp, Homo sapiens
gtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtt

SEQ ID NO: 18319 - DNA, 200 bp, Homo sapiens
gagaccagcctgccgacatggtgaaaccccatctctactaaaaattagctgggtgtggtggtgggcagctgtaatcccagctactctggaggctgaggcaggagaatcgcttgaagctgggaggcagaggttgcatgtgagcccagatcgtgccactgcactccagcctgggcgacagaaagagactctgtcccaaaaaa

SEQ ID NO: 18320 - DNA, 310 bp, Homo sapiens
  misc_feature 29: n = A,T,C or G
tttaaaagaactagagaagcaagagcaancacattcaaagctagcagaaggcaagaaataactaagatcagagcagaactcaaggaaatagagacacaaaaaacccttcaaagaaatgaatccaggagctagttttttgaaaagatcaacaaaattgatagaccgctagtaagactaataaagaagaaaagagagaagaatcaaatagaagcaataaaaaatgataaaggggatatcaccaccaatcccacagaaatgcagactaccatcagagaatactatgaacacctctatgcaaataaactagaaa

SEQ ID NO: 18321 - DNA, 297 bp, Homo sapiens
aaaaatcaactacacactgtacatcagaatagtctaacatcctgtttccaactggatagatgtcctaatttattctccatgttgtgtaatttttctgtctcacacatattgctttgagatagttactaatcaatgtaagaatctgaagaaaacttctttgtttccaggtcttcataatactaaaacttttaaaggagacaggctgtgttgtctatgggaaggcttggggtgggggagataaacaagccagtgttacttgtctgttttgattaaagatatcaaaaaacagattaaggg

SEQ ID NO: 18322 - DNA, 430 bp, Homo sapiens
  misc_feature 409: n = A,T,C or G
catgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctgtacatacagtgctcattggaggctcctgctaaaccttcttaaccagagaaataataggtatttgttagacctgagtgtacatttcacatgttatccttcacatatttctcatttcatctagacttcttaatgccttggtnggagccgcatcctcatcttta

SEQ ID NO: 18323 - DNA, 300 bp, Homo sapiens
  misc_feature 214, 240, 284: n = A,T,C or G
aactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaatggatgtgacttgttttgaatgttttgtattatacttgnttttgtgtgtgcataaatcattctgnaggatcttaagaaaaagagcccagaatgttgcttctattattgngcacaaccattgagag

SEQ ID NO: 18324 - DNA, 370 bp, Homo sapiens
tgatacttggcaccatggaatttttcattgatggatcgcctcattctacataaaaaataagggactataaatcagttatttagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagggataaaattaataatagttcacttgttatttgagattaattggcattggaaatgacattttatttacaacattatatgaatcaatgtccagtagcttaaaaggggatacggtgc

SEQ ID NO: 18325 - DNA, 366 bp, Homo sapiens
gggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggataattgcctgaacccgggagcagaggttgcagtgagctgagatcgtgccattgcactccagcctgggcaacaagagcaaaactcagtctcaaaaaacaaaacaaaaaacctgttggtatagtacgaaagaaacgtcttgcagttttctgttgcagagaattaattagaaccaacctgttggattatacacattcacctttcagaatcctttctt

SEQ ID NO: 18326 - DNA, 160 bp, Homo sapiens
cttttctagcccagcattgatctagaagcagaggaaacccagcgcttttaaaagttgttatgtggttttcttttaaaaagctcctgtttttggaaagtagaatttatgggtacaacgtatgttcattatttgtacataaaataaaaccatttaaaaagtt

SEQ ID NO: 18327 - DNA, 302 bp, Homo sapiens
  misc_feature 117, 197: n = A,T,C or G
ccatcctggccgccttagcggtagtaactgggtgttatgaatcacatgaaagcatggaatcttatgaacttaatcccttcattaacaggagaaatgcaaataccttcatatcccctnagcagagatggagagttaaagtccaagagaggatccgagaacgctctaagcctgtccacgagctcaatagggaagcctgngatgactacagactttgcgaacgctacgccatggtttatggatacaatgctgcctataatcgctacttcaggaagcgccgagggaccaaatgagactgagggaag

SEQ ID NO: 18328 - DNA, 350 bp, Homo sapiens
  misc_feature 47: n = A,T,C or G
ggcgacaaaaatgataccttttaaattttgttattgagacttttttnccacagaatactttttcctggagcacatctatcagcagttagatagtagtcatgggaaatgtcaggctatacaacctagaaactagttgtatgaaagttctgtttatatatatatataatgatgtaatggatcatcttttcttgtctttgaaatatccatgacatattgttatattaaaaagtaggtggctgggcacagtagctcatgcctgtaatcccagcccttgggaggctgagacaggaggattgcttgagtccagaagttcaagaccagcttgggcaacatggcgaaacctcatctct

SEQ ID NO: 18329 - DNA, 300 bp, Homo sapiens
ctgttacaactgacaacattggcttgctgcagctagtgagtcttgagtccgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagctgtgtaatggaatgtattttcaaatact

SEQ ID NO: 18330 - DNA, 373 bp, Homo sapiens
atgcttttaggcgatagagtttaatctccctcctttgagaccaggctgaacttagtgaattgcttccaaagaattgagtatggatgggaaaaaatagtaaccttacagtgaagaaacctggcaaacattaccttaacagaatgactgaagataaaatcacaagtgatgtcatggagacataatatacctccgatattatgtgatgagaaggacacttaacctctgtggttttctttccaaaaacccctaactccagcctaagcatgtgacaaccatcagacaaaatcaaactgagggatattttacacaatattagatgagtcagtgctcctgaatactgtcaaggttatgaaaaacaagaaaaaaattgaga

SEQ ID NO: 18331 - DNA, 304 bp, Homo sapiens
  misc_feature 246, 297: n = A,T,C or G
gaactactctcacttaccttcctcctattctgtctcccacaatataacactgtatagtgttgtattaactaaacacataggtaggtagctgttatatatcatcacttatatatatcatcttaattttcatacttctatgaactgtatactcttattattttccctttatagatgaggaaaaatcgggcagggacattaggaattttaatatcacatagccagtattgacagaactagaggagaggnggactataataccatagccaatgtaagttcccctatagtatagttctctgngatttag

SEQ ID NO: 18332 - DNA, 330 bp, Homo sapiens
  misc_feature 158, 195, 217, 292, 297, 301: n = A,T,C or G
gctacttgggttagactttgtttttgacctaacatcccttccttaaatgccttctgtagtttcagatcagtagggagaccatataataattttatggtacctgtttcaaaacatattttttctgtttttataagtaagttgatattaattaaactctnggcaatatttcttctttcttaaaggaaaatatacctnaactttttttcttttacactgngaaacatacacagtaggaaattctggtactctctggtattaaatacataaatgaaaatacatttttttccatatnggcangtangctacaaatattaaaggagggagaaaagg

SEQ ID NO: 18333 - DNA, 320 bp, Homo sapiens
aagtcaatcctaagccaaaagaacaaagctggaggcatcacgctacctgacttcaaactatactacaaggctgcggtaaccaaaacagcatggtactggtaccaaaacagtgatatagatcaatggaacagaacagagtcctcagaaataacgccgcatatctacaaccatctgatctttgcaaacctgagaaaaacaagcaatggggaaaggattccctatttaataaatgggctgggaaaactggctagccatatgtagaaagctgaaactggatcccttcttacaccttatcaaaaatcaattcaagatggattaaa

SEQ ID NO: 18334 - DNA, 425 bp, Homo sapiens
taaattatccagtgtatggagaaacgacacaggttaggagacgacgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgtctgggcagaccttatccaaagtctggacaactgtccttagactgatgagcaaaggaggagtcaactaatgaagaaatgaataataaattttgacactgaaaaacattttattaa

SEQ ID NO: 18335 - DNA, 210 bp, Homo sapiens
gggtgggtggcgattgccttagagggaacccctaaattggatttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccgtgtatgacagtctc

SEQ ID NO: 18336 - DNA, 311 bp, Homo sapiens
agaccagtgtaataccctgaatccccttgtactcccagagtacctcatccacgctttcttctgtgtcatgtttctttgtgcagcagagtggcctacactgggtctcaatatgcccctcttggcatatcatatttggaggtatatgagtagaccagtgatgagtggccaggactctatgaccctacaaccatcatgaatgcagatattctagcatattgcaagaaggaaggatgggcaaattagctttttatcttctagcatttttttactacctatatggcatgactatgtttgggggagctcttagaaca

SEQ ID NO: 18337 - DNA, 309 bp, Homo sapiens
tggggataaaacatagggaaatattatttaaataaagatgaaagaaaaggagcccacaaaggaagctgaaaaggcatagtcaaaaaaagaggcttgccaaagtgccacctttgaagctctgctgttacactttataaggaaacttttggttacctgagattgcatgcatttataaaagtttctattattaggaagacaataataatgataaggctctttctcattgttgtcagtgtaatttatctatttaattatagaacctagttccaggatgcttaatctgaagtatatacttggggcaaaatgaat

SEQ ID NO: 18338 - DNA, 330 bp, Homo sapiens
gaaggaaaggcaaaaagaagctgattactattcccgctgtcccatggatactcgtcactccttctgcgatattcttcacatgggagctttgtctgggtagaaatggggagtgggatcagggagggctagacactggggcctggggacaagagccagggtttcatgtccttaaacacattaaaattctagacagatagcaaatgtaatgaaaattgcaacctgaatgtgttctgatagacaaagttaaacactttagctaaagtattacaagtataattaacaaaaagttgcaatactctgaattgcttctgtgaataaagcttttaagag

SEQ ID NO: 18339 - DNA, 186 bp, Homo sapiens
ttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaaaaaaaaaaaaaa

SEQ ID NO: 18340 - DNA, 479 bp, Homo sapiens
tacggtcccggaagacaacgttggcatgtgaaacacttcccattaaccggttgttgctgctgtctgttttcgtgattcagcaagtttcatctcaagagctttcctgtaaaggccgctgccttgagtccttcgagagagggagggagtgtgactgcgacgcccaatgtaagaagtatgacaagtgctgcccgattatgagagtttctgtgcagaagtgcataatcccacatcaccaccatcttcaaaggaaagccctccccttcaggagcatctcaaaccatcaaatcaacaaccaaacgtcaccccaaccacccaacaggaggagacttagaaagtatagaatcaggaggaatacagaagacattctggttctgaaaatcaagagtcctcctcctcctcttctcttcttttttcttcaacaattcggaaaatcaagcttccaaaaatcagctgctaatagagaattgcagaagaacctc

SEQ ID NO: 18341 - DNA, 336 bp, Homo sapiens
taagcccatatcactgaaactcccttaggtggaggcaagtcacagccctacagtaaaaacagtggcactattgctaggcagttcatgccatttgcgaatttgaaccccgatgacagggctgtgaagaaatgtgcctagataagcttcactgcccattccaaccctgaatgagtgcaagcttttgagatgtgtgctactaaggatcccacatggtggattgagtgttttggttttaaataaaacaggagcggagttttaaataaaacaggagtggtaaggaagcttgttgtgacaaatggtatacctgcgccctgcctctaccttgcctcacaatct

SEQ ID NO: 18342 - DNA, 449 bp, Homo sapiens
ctgtttgaccgaacaggtgatggcaagatcctgtacagccagtgtggggatgtgatgagggccctggccagaaccctgccaacgccgaggtgctcaaggtcctggggaaccccaagagtgatgagatgaatgtgaaggtgctggactttgagcactttctgcccatgctgcagacagtggccaagaacaaggaccaggcacctatgaggattatgtcgaaggacttcgggtgtttgacaaggaaggaaatggcaccgtcatgggtgctgaaatccgcatgttcttgtcacactgggtgagaagatgacagaggaagaagtagagatgctggtgcagggcatgagggacagcaatggttgtatcaactatgaagagctcgtccgatggtgctgaatgcttgaggaccttcccagtctccccagagtccgtgcctttccctgtgtgaattt

SEQ ID NO: 18343 - DNA, 277 bp, Homo sapiens
aaacatgtgctgtgtccactcagggttgaatggattaagggtggtgcaagatgtgctttgttaaacagatgcttgaaggcagcatgctgggtaagagtcatcgccactccctaatctcaagtacccagggacacaaacactgcggaaggctgcagggcctctgcctaggaaaaccagagacctttgttcacttgtttatctgctgaccttccctccactattgtcctgtgaccctgctaaatctccctctgcgagaaacacccaagaatgatcaaaa

SEQ ID NO: 18344 - DNA, 289 bp, Homo sapiens
gaagatggccagcccgctgcctccccagcggccacagctcctttgagtggggggggcacagccaggatgtattcctgacaataaggatccttttattttcatttctgcataatgaaagagcctttcgatttattagaagtgggttttcctccctacatctttaaattcttggtctctttagtcctcatcccttgaatggacttgtcagctacctccccaggaggagttcagaagcttctgttggcatcacttgagtagatgacaagctgtaaggtatctgctgctaacg

SEQ ID NO: 18345 - DNA, 213 bp, Homo sapiens
gagacatatggaagccatgaagatttaaatgtcaaaaaaacagtatctcatagaacatctcctttgactcagtgcaatgaaatgagacctcaatgacaaaaagctaaggattgataaagttatacagggccaatcataaccaaacaaaaagaaagagatccctttatatccctttattaatctcagaaaacatagattttacgaaaaaaaaaa

SEQ ID NO: 18346 - DNA, 246 bp, Homo sapiens
gatcgctttgcccggcggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgt

SEQ ID NO: 18347 - DNA, 305 bp, Homo sapiens
  misc_feature 30: n = A,T,C or G
gaaactggagggtgaatcttgggacagcanctccataaagttacttatgaactcctgagctcccccaagttgaaggaatctgtgtaatctgatctaaattgtattgacaataccatttataatagctcctctcaaattgaaagactttagtataaatctactaaaacattagagaatttgcatgctgaaaaactacaaagtgctgatgaaagaaatcaagatcaagtaaatggacagacataccatgttcatggattagaagactcaacgtagtaaatatggcagtgctctctaaattgatttat

SEQ ID NO: 18348 - DNA, 199 bp, Homo sapiens
cagcaatgtccagcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaatgtttaacgggttaataaaaaaaaaaaaaaaaa

SEQ ID NO: 18349 - DNA, 300 bp, Homo sapiens
atggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaatttactgataaacttagggcacattaattaatgtatattc

SEQ ID NO: 18350 - DNA, 302 bp, Homo sapiens
aagaataaaaaagaaatccatatgttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatcttgggaaaaactcaaaaaaaaaaaaaaaaa

SEQ ID NO: 18351 - DNA, 200 bp, Homo sapiens
acatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcaattatttagtaaataatctcaata

SEQ ID NO: 18352 - DNA, 300 bp, Homo sapiens
  misc_feature 35, 142, 247, 283: n = A,T,C or G
ctccgtggccttagctgtgctcgcgctactgtctntttctggcctggaggctatccagcgtactccaaagattcaggtttactcacgtcatccagcagagaatggaaagtcaaatttcctgaattgctatgtgtctgggttncatccatccgacattgaagttgacttactgaagagtggagagagaattgaaaaagtggagcattcagacttgtctttcagcaaggactggctttctatctcttgnactacactgaattcacccccactgaaaaagatgagntgcctgccgggtgaacc

SEQ ID NO: 18353 - DNA, 250 bp, Homo sapiens
caatgaaatacaactgcttgatagaggcacagtgagaactagcggttcgtgcctatttgttaaataactcacagatacctgttatacagataatgttctcactacccataatatgtaggaaccattgtttctccttagccgtaggatgcatacacctatccatgttcattctgacatcctttgttgtctttataattcatgtggtagttacctataaataaaaacaaatatgcgttaaaaaaaaaaccag

SEQ ID NO: 18354 - DNA, 242 bp, Homo sapiens
aagaaacctaggaccaaagcacccaagattcagcgtcttgttactccacgtgtcctgcagcacaaacggcggcgtattgctctgaagaagcagcggaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccag

SEQ ID NO: 18355 - DNA, 320 bp, Homo sapiens
ggccgacatgtttatctaatttacagtctccttacttgcaggctcatagacctttagctgactgaatttttcagttaacttagtgtagccccaggataatgttaatactttcataaatgcaaaattaagaattgttcagtaatgttaaccttttagaaaatatgaaataggataatctcctaaaagctgtaaaatgagaaccttcacatttaggaagacagaatgtttttttccccccaattgaaaatgagggagataggattatatagttgtttgaattcaagatagaactttaggatctatatagtaactactgggaa

SEQ ID NO: 18356 - DNA, 350 bp, Homo sapiens
gaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatctctttttttctggaggctg

SEQ ID NO: 18357 - DNA, 301 bp, Homo sapiens
cagtgtagttatgaaaatatattgaaggacaggaagtgtacacgaagggatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactga

SEQ ID NO: 18358 - DNA, 340 bp, Homo sapiens
aacatcatctttgtggccacacattgttttatgagcgtgagtcatcagactggctggctccttaaatgctgctgtgcgattctctaggcagcagaaaacaaggagagaagatatgaagtgtatctcatcgagctttgtaggagggccagtatcattcaccaaaggtgatggggggatttaccattatggagtttgcttgtgataaaaaattattgatcaacttaaactctaagagaaaaagatgatgctgctgcattcttggaaatattataaaattggttgggtatcggctattttaacagccaccagcttaacgaatttctgcagaaacttgatcctt

SEQ ID NO: 18359 - DNA, 180 bp, Homo sapiens
agttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgcatcttcagcaaaccctgatgaaggcta

SEQ ID NO: 18360 - DNA, 380 bp, Homo sapiens
tcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttg

SEQ ID NO: 18361 - DNA, 280 bp, Homo sapiens
gaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgagaactgcagctgcaatcccgacaaatgcaagattattatctgatcattccaaaccaactgctgaaacggtagcacccgacaacactgcaatccccagtttaaggctgagctg

SEQ ID NO: 18362 - DNA, 401 bp, Homo sapiens
gaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggggattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaac

SEQ ID NO: 18363 - DNA, 410 bp, Homo sapiens
  misc_feature 40, 321: n = A,T,C or G
tctatcaaattaagcagcaacatggagaggcaaacaattnaaacatccggcaagacttctgaaaagacattttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgngcatagaattaattttcagccatgtggccatattttgtatccaaggatccttatttaaagctttcaacatgtacaggaaggtgggaaat

SEQ ID NO: 18364 - DNA, 303 bp, Homo sapiens
actaatttttagttgcttgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgcactataatatactgtatgtttacattttatttaaatttaatctcttatgatagggggataacctt

SEQ ID NO: 18365 - DNA, 229 bp, Homo sapiens
taaaaaacaaaaaaggattaggattgagccagcgccaaaaggcaatattactaccatgtagactgttataggtcaaattgtcccacttcacccagaattttagaaactagaagtctgggaggtactatatcagctgtagttgggtaattccaagtgctgataggactattcatcttttttattattggggcagatgaaacaaatgccaagttgcgaaatatgcagattt

SEQ ID NO: 18366 - DNA, 116 bp, Homo sapiens
gacagaccgcaggagatgaaactttgttttaggagacaccctactgggaatagcattacaaagagccacctctcatggctaagagaactaaacaggaaataaaaacagctcataaa

SEQ ID NO: 18367 - DNA, 301 bp, Homo sapiens
gtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcgggaggtatgtgacacatgaaaccaaacacttcatctacttctacctgggcaaggtggcattcttctggtcaaatctggtaaaagc

SEQ ID NO: 18368 - DNA, 169 bp, Homo sapiens
ggctgggtgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaaattct

SEQ ID NO: 18369 - DNA, 125 bp, Homo sapiens
caaaaaaattttcaattaaactcaaatattaaatatctataacttataaacaccaactttcaatgtaataaatgtatcctaatcttatgtatgtttaactggattacatagatttttatcttttg

SEQ ID NO: 18370 - DNA, 350 bp, Homo sapiens
  misc_feature 304, 312, 313, 314, 315, 316, 317, 321, 322, 323, 324, 325,326, 327, 328, 329, 330, 331, 332, 346: n = A,T,C or G
tactagacacccatcttgcaagactgctattagaagtctcactttcactgtgcctctgagtccattctttgaatttggacgggtaaatgtgtgttttttcagaaagaccagcctggcaacatggtgaaaccccatctctactaaaaatacaaaaattagctggacatggtggtacacacctgtagtcccagctactcaggaggctgaggcagaataatcaagttgaacccaggaggcggaggttcaagtgagccaagatcatgccactgactccagcctggcaacagagcaagcttcctccttnaaaaaaannnnnnaaannnnnnnnnnnnaaaggggggccccncggc

SEQ ID NO: 18371 - DNA, 299 bp, Homo sapiens
  misc_feature 40, 69: n = A,T,C or G
ctatcaaattaagcagcaacatggagaggcaaacaaattnaacatccggcaagacttctgaaaagacantttagcaggtagaagaaaagttgggctttcacaaaaggcatctgaacttttaatgaactgtgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataagg

SEQ ID NO: 18372 - DNA, 300 bp, Homo sapiens
  misc_feature 276: n = A,T,C or G
gaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggngattctctatgccgaaatgggtac

SEQ ID NO: 18373 - DNA, 262 bp, Homo sapiens
attattgtagcaattattgtaaaaatatttgaaccttagaatatcatcttcattatttttatgttctatcatgattctccatgatagaatcatggaggcaagctgatgaaatccaacttcctcattttaccaatgagaaaacaaagacctagaggagtactgggaatagccataggtgatagaataggtaattaaatatatctgtcaagactaatatataaggaagcttgatgatgatttactacttattacaaactactgg

SEQ ID NO: 18374 - DNA, 330 bp, Homo sapiens
agcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaatttaagtaggaaagcacccaaacacttctgctttcacttaagtgctggcccgc

SEQ ID NO: 18375 - DNA, 318 bp, Homo sapiens
gccaattacatccataaggggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattt

SEQ ID NO: 18376 - DNA, 194 bp, Homo sapiens
  misc_feature 39, 45, 46: n = A,T,C or G
caactttaaatttgcccacagaaccctctaaatcccctngtaaanntaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcgc

SEQ ID NO: 18377 - DNA, 237 bp, Homo sapiens
ggtaactactttccttactgccagtaaacataaaagaaaatctctaaccaaattctgtgcaaataaagacattaatgaaataaacattcattagcaagcagatacaaaactattcatatgttttatatactctctgagtatttaggtaatccagccactactttgcatgaatggttaacttaaggaagataagacatatatcacaaaactaaacaatatcttgagataactaaaaaa

SEQ ID NO: 18378 - DNA, 340 bp, Homo sapiens
ctggaaccgctgatgcgtgaaatggagagactttgccgttgaagctgctaactaccaagacactattggccgcctgcaggatgagattcagaatatgaaggaggaaatggctcgcaccttcgtgaataccaagacctgctcaatgttaagatggcccttgcattgagattgccacctacaggaagctgctggaaggcgaggagagcaggattctctgcctcttccaaacttttctccctgacctgagggaactaatctggatcactcctctggttgatcccactcaaaaaggacacttctgattaagacggttgaactagagatggacaggttatcaacg

SEQ ID NO: 18379 - DNA, 203 bp, Homo sapiens
ggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttgg

SEQ ID NO: 18380 - DNA, 300 bp, Homo sapiens
aataggcatcgaggctggcagccatggggtggggatttccattcactgttcgtatctgttactttccattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaaggcgctctggaacatgcaggaactgcccaaactaatttagg

SEQ ID NO: 18381 - DNA, 162 bp, Homo sapiens
aaggaattattctttttcgtcctgtcaagttgcaggaaacatcaaatattgactgtaaactgttatcaatttcatatgggacaaggtctgccatctcttcatgtacacatattttcacggcccttaattacttttttattctttaaaccttagctaaagtat

SEQ ID NO: 18382 - DNA, 181 bp, Homo sapiens
gatcctatgatgccagctaactcagactccagtgaagatgctgatgactgaagccccagcatgggccccattgcttgggccggctgctgtattttcatttactctggcccttggactatggaaacgtgggaggggcaggggagatgtggggaagtccaggactccaggaggtgaaaaaaaa

SEQ ID NO: 18383 - DNA, 313 bp, Homo sapiens
tggcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcctcatgcacttaaagaagtatttttagaataagaatttgcatacttacctagtgaaacttttctagaattatttttcactctaagtcatgtatgtttctctttgat

SEQ ID NO: 18384 - DNA, 324 bp, Homo sapiens
gtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggattcctttaccttttctataagttgtaccaaaacatccacttaagttctttgatttgtaccattccttcaaataaagaaatttggtaccc

SEQ ID NO: 18385 - DNA, 301 bp, Homo sapiens
  misc_feature 40, 72: n = A,T,C or G
aaaaaagtaccagctctggctggggtccagtgaagccttnggccaggcagccaaatcttgcctgtgctgggnatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgccagatgcca

SEQ ID NO: 18386 - DNA, 275 bp, Homo sapiens
ttcaatctgagcccagcaggagaggatggtagggttgccagggctcagaagtgcaagctgattactcaccccaccctgcctcgcgcacctttcctttgtttccttgggtgaatgcaggacagcagtggctgccttcccacctggcagtggtgtgtgtagaaagccagctggatgtttgtggtggggcctcatggtgcctaggaggagataaagatgaggaggtttttccttattgtataaatgaatatttgtatgattaaattaacacacacacc

SEQ ID NO: 18387 - DNA, 314 bp, Homo sapiens
ttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctggttaactttgtaagatgcaaagaggctggatcaagtttaaatgactgtgctgcccctttcacatcaaagaactactgacaacgaaggccgcgc

SEQ ID NO: 18388 - DNA, 301 bp, Homo sapiens
tactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgcaatcattacactaaaacagatttgataatcttattccagttgtattgttacaggccattaattaatatttctctggttattcctcctttcctccattgcatggctcacacctgtaaaag

SEQ ID NO: 18389 - DNA, 363 bp, Homo sapiens
tcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggcttcaatcctttt

SEQ ID NO: 18390 - DNA, 330 bp, Homo sapiens
  misc_feature 56, 105, 189, 197, 205, 228, 244, 252, 264, 279, 286, 315: n = A,T,C or G
atggccatgctgacattagcccttaagctgatgtttttgggctggacttaggcggnttctaatcaaggaagacttaaaatggcgatgctagtccaagatggcggngctgctgctctgcagtcatcatcagggcagcacatcacacacagcaactttttaaggacaattcggggttttcaaatgcaccancgagtctncgcacatncgaagctgaccgcagccttgccnatgctagcttagtaangaacattngttgactggggngcaggggatgagcangatagancagaaactgacaaatccgaaatttctcangccccaggcaactag

SEQ ID NO: 18391 - DNA, 310 bp, Homo sapiens
  misc_feature 31: n = A,T,C or G
gtttttcaaaaaaagcaaatgtataaaattnataggtaacagacaccattagctgctcaaaaatagtatgactaaattcagtaagtagctatgcaaatatcagcccaattaaatgaagaccctaataggtgcatgtggaaagcattgctgtgcagtgtggtgcctccactcagcattttcttctgcctctttacagagaaaccagtttcccctgagtgactcagggtgcatactgggaactgagaatgctgtgttcagagtgattactgaaaacatgggtaatacacttctttcatatgataataaaatg

SEQ ID NO: 18392 - DNA, 430 bp, Homo sapiens
tcctcctgtggaagaagtactgctctatcaagcagatataaaacaaagggattatgggtcaactaagtcttggaatgaatgctagctcaaacaaaattaaacagatctctctgttatcagcctgttcaatcaacgtacatcttgaatttctgcaggagaaatttgaatttaaaaacctgatgtacatcttgaatttctgtaggaaataaatggcaataccccaatttattaaatcactgaatcttatttttatgttaaagcaccttttaacatctactaaaactgggctttttatttagacacacttctgagaacactgacatctatcagtgtatgtggtcctttagaaaaggagctaagcagctgggcacggtcgctgacatctgtaatcccaccactttgggaggctggaggagcctgggtcacttga

SEQ ID NO: 18393 - DNA, 291 bp, Homo sapiens
cctgcaggacgaaaccatgaagagcctgatcgggcttgccatcctggccgcctgagcggtagaaaccccgtgttatgaatcacatgaaagcatggaatcttatgaacttaatcccttcattaacaggagaaatgcaaataccttcatatcccctcagcagagatggagagctaaagtccaagagaggatccgagaacgctctaagcctgccacgagctcaatagggaagcctgtgatgactacagacttggcgaacgctacgccatgggttatggatacaatggtggccta

SEQ ID NO: 18394 - DNA, 304 bp, Homo sapiens
ttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggcatctcgcaacttacaagcagctagaggcagccagaaaaattggatttcatgtctgtgctgctggatggatggctaagggcagagttggataccccattgtgaagccagggcccaactgtggatttggaaaaactggcattat

SEQ ID NO: 18395 - DNA, 290 bp, Homo sapiens
ctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaataaaaaa

SEQ ID NO: 18396 - DNA, 360 bp, Homo sapiens
aggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttgtactacactgaattcacccccactgaaaaagatgagtatgcctgccgggtgaaccatgtgactttgcacaagccaagataggtaagtgggatcgagacatgtaagcagcatcatggaggtttgaagatgccgcatttgggattggatgaatccaaatctgc

SEQ ID NO: 18397 - DNA, 302 bp, Homo sapiens
  misc_feature 40, 66, 256: n = A,T,C or G
actacctattgtagatattgcaccctatgacattggtggncctgatcaagaatttggtgtggacgntggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcttttttngctgtccaccaaatacaattcaaatgctttttgttttattttttta

SEQ ID NO: 18398 - DNA, 330 bp, Homo sapiens
tcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactagggtgcaactgtgaaggaaaaactttcttctttaaggatctcagtactggcgttttaccaatgagataaaagagcagggtaccccaaaccaatttcaaaggatttggggactaactgg

SEQ ID NO: 18399 - DNA, 310 bp, Homo sapiens
gttaaaggtgagctgtttcaagaggatgaccatggtgagcttcagttttactttatgcatgcagtaatgaatggagaatgagttcctgagtatactgaccaatagattataaaaatattcctcagcaattttctatagaaaagtgtgatatttattctgttaagatgtataaggcacagaataatgacttttcctgccttttacttaaaactctgatacctttgaagaattgagctttttataatattcatatttactggcacaaggagcttggtttgtgaaataatttaaatgtattaagggtgtttat

SEQ ID NO: 18400 - DNA, 281 bp, Homo sapiens
  misc_feature 100, 146: n = A,T,C or G
agtctacaagttccagtgggactgtacatacctttttagtatgttctgtgactctgctcattactttcctgtgctctacattgatccttgtagcagtttncaaatatggccatttttccctataagttttatgtagttaaatgctncctagaaacctaaataagatctattaatttctgacgagaggtgttcttctagaattaattacttttatcttttgtcttcatttgtggccaaaattatgtttactagaggaaatttgggatcattctcagctaatt

SEQ ID NO: 18401 - DNA, 300 bp, Homo sapiens
  misc_feature 30: n = A,T,C or G
ggatcgagcacaatggttactgtcaaagcngaccctcaagaaacagtttgtagcaacgtcaaggatgtataaagttggaaaacttctgattagctctcatccagtcttcatctctatttatcttagaagtttagtttccccacctcccctcccttctctaggtggacattaaaaccatcgtccaaatacatgggaatgcctgaatccattcacacaaacgtgtatcttactgagaagttccccgagagacgtttgaggcttgggattccaaacttgatttattaaacgtatagtcaccat

SEQ ID NO: 18402 - DNA, 183 bp, Homo sapiens
atcttctgccttggctggcctctgttgagggtgggtaagggaaggaaggaatgctcagcttggtgttctcagcccccttgctgagtctgcggagcaagagctacagctgtcttgatgctccctgagcaagtcccgagttgcctggtaccttgcagttcttggtgggagttaactgcccagcat

SEQ ID NO: 18403 - DNA, 370 bp, Homo sapiens
  misc_feature 30, 253, 275, 333: n = A,T,C or G
ctgtttgccctctttggcatcccgatggcnctcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagnatacctgattttttttcctttnaatttcctgggccaattcaagtccaagtgctaatacagcaacaattatgaatggaatnatctgggtggaaaataaaaagacacttctcaggtttc

SEQ ID NO: 18404 - DNA, 197 bp, Homo sapiens
  misc_feature 22, 23, 30, 68, 115: n = A,T,C or G
atctggtagaacaatatgtgtnntacattntgttcataattatatattgtgtatgttaaaactatttnccagttgttttgtctgtaaaactgtctttatcaatatgcttaatggntctttgtacaattttgaaagtttctacctgtatataatggatgttaaccagtatcaataaatcacttcgtataatcaaaaaa

SEQ ID NO: 18405 - DNA, 390 bp, Homo sapiens
ttcaggatatcaagaaaccagactgtgatgactgggagagcgggctgaatgcaatggagtgtgcattacatttggaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaaggtgggagcgcccgaatctggcttggcggaatatctctttgacaagcacaccctgggagacaggtgataatgaaagctaagcctcggctaatttccccatagccgtggggtgcttccctggcaccaaggcagtgcatgcatgttgggggttcctttaccttttct

SEQ ID NO: 18406 - DNA, 300 bp, Homo sapiens
gagctatgtagggtgagggagtctttccccagctcagcccaggtttgtttttagtactggataaaggtaataagactttatctgactgtaagtggaaagacacagccaagagtaaattgcaattgagtgaaaaccggtggaactggattgggttaattgattgtgtactatgctcagtcagcattcatcttcagtttttcaccttggactgcattcaaacatcaagtttgggtgggtatacattgggatttcctttccacaatattttctagcacatcattcaagaactcggaaagggaa

SEQ ID NO: 18407 - DNA, 400 bp, Homo sapiens
  misc_feature 30, 215: n = A,T,C or G
ccattctcacgtgattcttgtgagactctntttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggngctgactggtttctgtatattgcacaacagtcctcaaatacactgatgtatgaaactattcatacatcaagcagcatttttttcactctccttagaattggactatgcagttaaggcagataaaatgacagatgttcatatattacagggtacatatataaatcaaaattcctatataaactgat

SEQ ID NO: 18408 - DNA, 300 bp, Homo sapiens
  misc_feature 195: n = A,T,C or G
gctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggngccactgaggtgttgatgtggtttatgtcggagagattataggcaagcggggcatcattggctatgatgtttgaagaccaatctttaacatctgattatatttga

SEQ ID NO: 18409 - DNA, 270 bp, Homo sapiens
  misc_feature 168: n = A,T,C or G
agtgttttagatcaccccctccccaatgaagctaatactcacctgagttgtaagaaactccagctgacacaaaataaactacgagcagtggctctatcacatctgaacacacaatagctatgaccctaactgcgattgaataccccactatgcttagccctaaacccnaacagttaactgaacaaaactgctcgcagaacactgcgagccacagcttaaaactcaaaggacctggcgggggcttcagagattctttttggatgctgggat

SEQ ID NO: 18410 - DNA, 230 bp, Homo sapiens
agggttctcgctcttgtcgtgtctgctcaaaccggcacggctgatccggaaatatggcctcaatatgtgccgcagtgtttccgtcagtacgcgaaggatatcggtttcattaagttggactaaatgctcttccttcagaggattatccggggcatctactcaatgaaaaaccatgataattctttgtatataaaataaacatttgaaaaaacccttaaaaaaaaaaaaaa

SEQ ID NO: 18411 - DNA, 201 bp, Homo sapiens
attaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatt

SEQ ID NO: 18412 - DNA, 112 bp, Homo sapiens
tataaccaaaggttcaccatactttacccttacaatgtgcaatgcactccgatattttctattgtgtcatttttttttttaatcctggttacaattcaacccagaaataggg

SEQ ID NO: 18413 - DNA, 320 bp, Homo sapiens
agattgggtgagattgtctccctttgtaggacttggaaggaagtttagctgtgttattactcgagggacttttgattaccagcaaaaagagaaatggttagtgtgagagaacattcataggttttatttcagttttaattcagacttatttgaaggttttgacagagagatgctatataggcagggtatctttccaaagatttgattctagaactagattttaatatgataggcaaaaatcatataaaatttttggcaccctttagaacatgacttcttctcagatccctgatattaactttggttatgaaaacagaaaa

SEQ ID NO: 18414 - DNA, 128 bp, Homo sapiens
tgcagtgagccaagatcaggccactgcactccagcctcggggtcaagagcgaaactctgtctcaaacaaaaagaaagaaaggaaggaaggaaggagggaaggaaggaaggaaaaaaaaaaaaaaaaaa

SEQ ID NO: 18415 - DNA, 450 bp, Homo sapiens
tcaggatagttctcattcagtggttttcaaagtgtgattcccagatagcagcatcaacatgatctgggaacttgtcaggaatgcaaattcttgagccccaccccagaccttattgtgtcagaaactcaagggggtaggtcccaacaatttatgttaacaagccctccaggtgattctgatgcatgcttaagtttgaaaactgctgtttaaattcaacatatttcattgtagattaaggaaattaaaagccagatataagtgacttaacctaggccataaagcaagtaaatgcttgtaaatgtatttattaatcaatgttcagggtgaactgttgatatataaaattaataattggttaatcataatatgaagcttattctcaaactttcggtatgtgcctcactacgtttagaagtaataattttatactacatcattacaaaagcccta

SEQ ID NO: 18416 - DNA, 301 bp, Homo sapiens
tacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgtatttaaaagaaaattgagagaaaggactacagagccccgaattaataccaatagaaggcaatgcttttagattaaaatgaaggtgacttaacagcttaaaggttag

SEQ ID NO: 18417 - DNA, 288 bp, Homo sapiens
tacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcaggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaa

SEQ ID NO: 18418 - DNA, 299 bp, Homo sapiens
tggaatggaatggaacgcactcgaatggaatgggaatggaatggaatggaatggaatggaatggaacggcatgaatggaatgggatggaatggaatggaatggaatggaatggaatggaatggaatggcacgaatggaacagaatggaacggaatagactcgaatgggatggaatggaattgaatggactctaatggaatggacatgaatggaatggaatggactcaattagaatgcagtttgaattgaaaaggatccaaaagggaatgcaatggaatgcattggaatggaatggaatg

SEQ ID NO: 18419 - DNA, 380 bp, Homo sapiens
ggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggcaatgaaaatgccttaaaaggaatgcatatggataaagttgcacttataacacccttcaacaaaatctaattttaaattgtctttttcttttctattaagggtttctttttcagtgtctaccattgtacttataactgttattaaataccaaatc

SEQ ID NO: 18420 - DNA, 159 bp, Homo sapiens
aatatttaattaccggttgttaaaactggtttagcacaatttatattttccctctcttgcctttcttatttgcaataaaaggtattgagccattttttaaatgacatttttgataaattatgtttgtactagttgatgaaggagtttttttaacctgtt

SEQ ID NO: 18421 - DNA, 339 bp, Homo sapiens
aacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagatccaccaaataagctatatactttggttacctatgtacctgttaccactttcaaaaatctacagacagtcaatgtggatgagaactaatcgctgatcgtcagatcaaataa

SEQ ID NO: 18422 - DNA, 389 bp, Homo sapiens
caaaagcacgtacaagatgttcactacagctgtcttcataatagtcaaaacctggaaacagctgggcgtggtggctcacacctgtaatcccggaactttgggaggctgaggcgggcggatcacaaggtcaggagttcgagaccagcctggccaatatagtgaaaccctgtgtctactaaaaataaaaaaattagctgtgtgcggtggcacgtgcctgtaatcccagctacgtgggaggctgaggcaggagaatcacctgaacctgagaggcagaggttgtagtgagccaagatcatgccacttcacgccagcctgggcagcacagtgagattccgtctcaaacaaatctggaaacaacccaaatgtccattaacgagaatgggtgatag

SEQ ID NO: 18423 - DNA, 390 bp, Homo sapiens
gccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgacatgtatcttgatcatttataaagccactgtgatctataaatcaagaaaatccattgcataaccatttttaaaagcaaaaattaagacatccttaattaaaaagttcaaatctagacactaaatgtgtgtgaatgt

SEQ ID NO: 18424 - DNA, 300 bp, Homo sapiens
  misc_feature 30, 92, 126, 132, 171, 194: n = A,T,C or G
agtctgagctgactctgttactgaagattnaggagtattgctatgacaacattcatttcatgaaagccttccagaaaatagtggtgcttttntataaagctgaagtcctgagcgaggagcccattntgaggnggtataaagatgcacatgttgcaaaggggaagagtgttntccttgagcaaatgaaaaagttngtagaatggctcaaaaatgctgaagaagaatctgaatctgaagctgaagaagggactgaattttgaaactacaccctcagtaaagcaaacaggagttgtagataaa

SEQ ID NO: 18425 - DNA, 322 bp, Homo sapiens
tttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagttta

SEQ ID NO: 18426 - DNA, 190 bp, Homo sapiens
ccctatagaagaactaaggatagtataagtaacatgaaaacattctcctctgcataagcctgcgtcagattaaaacactgaactgacaattaacagcccaatatctacaatcaaccaacaagtcattattacccccactgtcaacccaacacaggcatgctcataaggaaaggtttaaaaaaaaaaaaaa

SEQ ID NO: 18427 - DNA, 470 bp, Homo sapiens
cttgagaagtttgacataaagagcttctgcaagatcctggggccattatcctactccaggatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcaagttttcataggtatccatattttattactgtttattacttccatgaattttaaaatctgagggaaatgttttgtaaacatttattttttttaaagaaaagatgaaaggcagcctatttcatcacaagaccacacacatatacacgaatagacatcaaactcaatgctttatttgtaaatttagtgttttttaatttctactgtcaaatgatgtgcaaaaccttttactggttgcatggaaatcaagccaagtttataa

SEQ ID NO: 18428 - DNA, 251 bp, Homo sapiens
acaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggacatgactgatcttgaaaaaaaaagcaaaagcttaaatatttgatacaagtttacttagctacaacatactttacattggtgcctttagttatct

SEQ ID NO: 18429 - DNA, 307 bp, Homo sapiens
ggaagaaaaagcatcaactaacgagcaaaataaccttttaacatcataatgacaggatcaaattcacacataacaatattaagcttaaatgtaaacaggctaaatgctccaattaaaagacacagactggcaaattggataaagagtcaagacccatcagtgtgctgtattcaggaaacccatctcacatgcagagacacacataggctcaaaataaagggatggaggaagatctaccaagcaaatggaaaacaaaaaaaggcaggggttgcaatcctagtctctgataaaacagactttaaaccaa

SEQ ID NO: 18430 - DNA, 276 bp, Homo sapiens
ttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtct

SEQ ID NO: 18431 - DNA, 268 bp, Homo sapiens
  misc_feature 26: n = A,T,C or G
ggattaatattggcatgtaatatttnttagcagtagagaactttctgttgtcattcatcactcactctccctttcagcactgagcttgctggttttattaaaaaagtgcgaagcaaaaacaagaactcactctcaggattgagtattgatgaaattgccaaagagtgacagaacacattctagatgaacagaaaaagaaaaaggaatttaatctagatgtccagtttatccttattaattataaaatatgagaattggtaaaaaaaaa

SEQ ID NO: 18432 - DNA, 214 bp, Homo sapiens
gaatcctggctccaacacttattgtctgtgtgactttgggcaaggtagttagcctttctaagccttaacctcttcacctattaagaaggcttaatacataacttaaaaggtaactgaacaccagtgaactaatatgtccaaaggatatgtcacatgatacatgctcaaaaattgacaatccgaccataagatctaatatatgaaatattataat

SEQ ID NO: 18433 - DNA, 348 bp, Homo sapiens
aatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgcctgaagaaagatttacatagccttacacttctctctactgaatatcatacg

SEQ ID NO: 18434 - DNA, 180 bp, Homo sapiens
aacaacatgtaatattgtctttttaaatttaaaccttaaactttggaaaataaatcctgcagagtggcttaataatagggatcctcttgatttttttttcagttaagcaattagaaaacagcaaagattttaatctccttttccctcaaaaatgaaaaacattccatctgtgttaatggc

SEQ ID NO: 18435 - DNA, 343 bp, Homo sapiens
tgagcagatttttaggactttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaag

SEQ ID NO: 18436 - DNA, 353 bp, Homo sapiens
cgctcagacttattatttatgatccttgtaataaaagggacaataatttcctgctcagacctccttcttagacaatctgcacagtacacatctccagaaggatagcccacatatcccttgccatcacttcgtctggccacagctgtgctagtagaagtgcaattgaccccaatattgggggatctaatatctctcccatttgtctggaatttggacacagaagccaaattagttcatctgcagaactaaactgcatggtcatgtagagatgatgccacagccacagcagaggaaagctaaagtggggaaggagagagagcatcactgagcagagaaaaccaatctagtgaaag

SEQ ID NO: 18437 - DNA, 208 bp, Homo sapiens
acaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaat

SEQ ID NO: 18438 - DNA, 350 bp, Homo sapiens
gaactgtttggctcacttccagttaagtttgaatgaaaataataattttctacttggagttgaagagggcagaatccgcagctctcatcattgtgatgtgtagcatgtctgccctctgactggacatcattgccattaactttcttctggcatcacggcaatgtcacgatgcccagacttggagcaaggcaaccttggagcagtccactcataaaatatggaacacccattttaaaatttaagttttggccttaaagacaactcaggggtaatataaagtgggtactcggctaaattaattgaagaaagattaaaaatgggttggttctctatcagaactgcgaactagg

SEQ ID NO: 18439 - DNA, 113 bp, Homo sapiens
  misc_feature 27: n = A,T,C or G
gattaaaacactgaactgacaattttnagcccaatatctacaatcaaccaacaagtgattattacccccactgtcaacccaacacaggcatgctcataaggaaaaaaaaaaaa

SEQ ID NO: 18440 - DNA, 167 bp, Homo sapiens
tctaagtggttgggttttagggatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttt

SEQ ID NO: 18441 - DNA, 405 bp, Homo sapiens
tgagccacaaagggagaatgctgttgaatcaaaactcttgatctttaagttaagtactcttgatttgtttgtttgaatatcttagacctctgctgaaggcttaaatcacatttaatcacattttcaaatcagaatttgattgtttttaattatatcaaaggtaagaggttttgtaatcatgatcttatgttgattttcctttacagggagttaaactcgaagaccaccttgaaatttgtgcacacatcttttcatggggtcggacatgactatgtgcagttggcttttaaagtgtttggttttaagcctccaattccagtaccagaacaaaaagatcctgatccagacttttctaccgttaaatgtccaaatcctgaagaaggagaatctgtgctggtatttttt

SEQ ID NO: 18442 - DNA, 340 bp, Homo sapiens
acaggagtataccagtttatatataaaaatgtttttaaacttgacaatcattacactaaaacagatttgataatcttattcacagttgtattgtttacagaccatttaattaatatttcctctggttattcctcctctccctcccattgcatggctacacctgtaaaagaaaaaagaatcaaattgaatatatcttttaagaattcaaaactagtgtattcacttaccctagtcattataaaaaatatctaggcattgtggatataaaactgttggggtattctacaacttcaatggaaattatacaagcagattaatccctctttttgtgacacaagta

SEQ ID NO: 18443 - DNA, 344 bp, Homo sapiens
aagatgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagt

SEQ ID NO: 18444 - DNA, 227 bp, Homo sapiens
tgtgctgctggaggttagcttcatatgacattacattttgactagagacaaaagaaaaatgaaatacttaaaacatctaccagaacagaattaggactggaaagcagcggtcttagctgacaaacaagttgtgccatctgagactcatgggagtaaatctcctctttcatagtaaaatctcattacagaatgttccttgactttggcaatttttctgggtccaaaaa

SEQ ID NO: 18445 - DNA, 330 bp, Homo sapiens
aagtttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagtacttaatgtttggtaacttttatgccttcactttacaaattcaagccttagataaaagaccgagcaattttctgctaaaaagtccttgatttagcactatttacatacaggccatactttacaaagaatttgctgaatgggggaccttttgagt

SEQ ID NO: 18446 - DNA, 244 bp, Homo sapiens
  misc_feature 25: n = A,T,C or G
ctggtcttcttcaagagagctaagnatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggcaataaagatatatttctttagaaaaaa

SEQ ID NO: 18447 - DNA, 300 bp, Homo sapiens
gacacaaaatattatactaatatgttgacatttcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgataggtggctgca

SEQ ID NO: 18448 - DNA, 360 bp, Homo sapiens
aaaaaaaagaaaacttaatttggaaatggttctaattgaaaaacctctacttagagtatggattttgatttttaaaaattaaaaatcaaatattttgggctgggcatggtggctcacacctgtaatcccagcactttgggaggctagagtgtacagatgacttgaggccaggagtttgagaccagcctgaccaacatggcgaaacttcatctctactaaaaagacaaaaaattagccgtggttgcaggtgctacttgggaggctgagcctgagaattgcttgaacctgggaggtggggcttgcagtaggccgagatcgcaccgctatactccagcctggtaaacagagcgagagctgtct

SEQ ID NO: 18449 - DNA, 307 bp, Homo sapiens
gtttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagccattaaccatttctatagcatgatttcttcaagtaaaaggcaaaagatataaatttataattgact

SEQ ID NO: 18450 - DNA, 249 bp, Homo sapiens
gtcacccaaacacttctgctgggcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagaatttttatacggaaaaaattgtattgaaaacacttagtatgcagttgataagaggaatttggtataattatgg

SEQ ID NO: 18451 - DNA, 310 bp, Homo sapiens
tgggaaggagcacgttgggcacgggaccaattcgggaacaaatactactacatcccgcagtacaagaactggagaggacaaactattcgagagaaaagaattgtagaagcagcaaataaaaaagaagtagactatgaagcaggggatattccaacagaatgggaagcttggattagaagacaagaaagactccacctactatggaggaaatactaaagaatgagaaacacagagaagaaatcaaaataaaaagccaagattttatgaaaaaagaaaaactccttagtaaagagccagtgaggaactcctg

SEQ ID NO: 18452 - DNA, 322 bp, Homo sapiens
tgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagct

SEQ ID NO: 18453 - DNA, 304 bp, Homo sapiens
  misc_feature 25, 35, 67: n = A,T,C or G
ttagactgatgagcaaaggaggagncaactaattnagaaatgaataataaattttgacactgaaaancattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaaaa

SEQ ID NO: 18454 - DNA, 321 bp, Homo sapiens
catgaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctct

SEQ ID NO: 18455 - DNA, 429 bp, Homo sapiens
  misc_feature 2, 7, 8, 9, 13, 14, 22, 23, 32, 42, 51, 54, 70, 81, 85, 90: n = A,T,C or G
gncgggnnngggnnggggtttnntaagattcncactggaagnaccccggcnatnttgggggatggacctnctcgagttggntgcngattngtggcgcgccaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcagaaaaaaaa

SEQ ID NO: 18456 - DNA, 260 bp, Homo sapiens
acagagtccaagaggataaccattttggccaagaacattagctagtacatggcagatctgtttctcaaattgagatacttgatgtttttgctgggtaggaggagaaacaagagggacagtggccagttcacggagactatagcagtagggttctggggcgatgttgcggggagcagcatgatttatcacaacccttctgtacccagagagtccccagtgctgttttcttatccttcattagtccctcttcttgttccgta

SEQ ID NO: 18457 - DNA, 317 bp, Homo sapiens
tgtgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactgccataggaaatgctgtttttttgtattggactttaccttgatatatgtatatggatgtatgcataaaatcataggacatatgtacttg

SEQ ID NO: 18458 - DNA, 135 bp, Homo sapiens
taaattgcctaaacgtctaccttaagtcattggaaaaagaacaaacatctcaaaaggaaaaggaagtaataggattagagtgaaaactggtgagatagagagtagaaaaaaaaaaaaaaaaaaaaaaaaaaaaaa

SEQ ID NO: 18459 - DNA, 300 bp, Homo sapiens
aatgagtttgatatgtagcagcgttggtatgtggacaggccgaaccaactgagcgtaggcaagggagaggaaacagaataacactagatgacggaagtgactaaggctgaaaaaatagaaaatgagtagcagataattcaacacctatgggcttaaacggaaaatgtgcgatagcgccttattagtgaaactatggaaaaatatatcggactggtgcaccattgtgtgcatctcagaaagaaagggacctccacttgtctaattgcttggagcccgaaaggaggaaatgtgctgtgtgct

SEQ ID NO: 18460 - DNA, 358 bp, Homo sapiens
gagtgagaaagcctggctgtacaaagccatcagaacagggaccatgcagctttaacagttgaaggccgaaaacatctattgaacagctgcagtacagattgccacagcacttagaaaaatgcatggaacattataaggactccatgaacattgaaatggatgaatgagttaatacatggataaagaataaatgaatgttagtgttatagggaaaaaggaataaataattatgatactctacttgttaaagctctccctgagcctcagttatataattcataaaatggagatcacatcaccagtttcactggattataaagacgattaaatgatttaacatagcatatagcacaatgct

SEQ ID NO: 18461 - DNA, 300 bp, Homo sapiens
  misc_feature 262: n = A,T,C or G
cctggcagacaattgagtaatattttgatgacttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtggngcaaactcttgagggttgattatgctgcaatttagcat

SEQ ID NO: 18462 - DNA, 239 bp, Homo sapiens
atcccacacattttggtattttgactttaaaaatagtgaaacaaatgccctgggttataatagtgaagaaagaggattgattcctagaagatcactaatcttagacaaatcagttttttatagagcttcctgatttgtgcaataaagaaaaataattgtatctcccagacctattagaagagaaatattagctatcatacataaaattgacactatacacacacaaaaaaaaaaaaaaa

SEQ ID NO: 18463 - DNA, 310 bp, Homo sapiens
cgcggcatagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagaagatgcatgctttaggaactgggaggagataagaagagaaa

SEQ ID NO: 18464 - DNA, 386 bp, Homo sapiens
atgggacaggatggcatcactcagggaaagagcacagagtcagaagaaaatatgacccaagaccaggccttgaagaactccgatatttaatgtttgggtagaagaaaaggcaaacgaaagtatctgaaaagatgggccagagaagagagaatcaaccaaggggagatggtcccagaagtcaaacagaagggagtgattcgctgtgatgaatgctgcagaggccaaataaggaaaagaagacagcaagaagaagccactttgagcccctatgatttcatctttgatccactcatccagcactccatactccttgatccctacccaccaaattctccttaaaagccctggtctccaaatgttcaaggcgaccgatttgagtaataaaa

SEQ ID NO: 18465 - DNA, 178 bp, Homo sapiens
tctgcttttcacatagatatttgattgggtacttgggaccatttggtagaaaagtaagatatatggggagaaaggaaatgactatttcaggttcctatatgtggtttaattgtggctccttttccttacattgaggctctcgctctgattgtaattacattaaatcaaaatctttact

SEQ ID NO: 18466 - DNA, 390 bp, Homo sapiens
actcagaggttggggtcagcaatctgtgtttaacaatcagaacctagacaaaagcaaatcacagtgctttttaaaaaatgagcggaaggagagaattcatatgtatggattccagaatcaaatatgcaatgacttttattctgaagaaaaagccaagcagtttgaaattaaatggtaaagtgactaggctgagctagtaaaaaacataaaatgcccagtattttagatgtaattcaagttgtattacttttatataataacctaaattggctggttgagtattgccaagagcgtttcccaaaaggaatttgtaactgctctaatgaagagacagatattaggtgtaactcacatatttgtggttatggaaacttagcatatccatggtaa

SEQ ID NO: 18467 - DNA, 292 bp, Homo sapiens
ggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgg

SEQ ID NO: 18468 - DNA, 241 bp, Homo sapiens
aggctgttggttcaaacttttgggagcacggactgtcagttctctgggaagtggacagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattg

SEQ ID NO: 18469 - DNA, 308 bp, Homo sapiens
tgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgcaggagtggttcgaaatcacggtggttatgttgatgtaatgcctgtggacaaaagaaagacctacattgcttcttttcagaatggaatcttctcagaaagttacaggaatcctccaggaggaaaggcattcagag

SEQ ID NO: 18470 - DNA, 314 bp, Homo sapiens
tttacaactctcttgcaaggttccctggttgtgaaaatacatgagataaatcatgagggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacc

SEQ ID NO: 18471 - DNA, 164 bp, Homo sapiens
  misc_feature 73, 101: n = A,T,C or G
agcagagagtaagtgccttaaacagtatctggtgcgtagcacccccttgagaaatactagcttttattgtttncattgaattactgtctcatggaattctnacaactacatcatgaggaaaatagtattaatagtattatccccatttcccaaaaaaaaaaaaa

SEQ ID NO: 18472 - DNA, 233 bp, Homo sapiens
tggaagcagatgctctataatttgtgatagcattctcataaatggagtcctacacataattggacagagatgtggaaatggtggtttccttctgataagggatacagtggaccatgtcgcttatatatcaccctactaggggatataattttcccttctaagcaagggaaatggcagtgctaaatagttttgtaaagtttttgaatgagaagcttttaggtaaagataaactg

SEQ ID NO: 18473 - DNA, 309 bp, Homo sapiens
cataacagatgtttcaagttatctcaacttcttcatccactagtttgtatatgttacatggcaagtaactgttgattgattctgagtcttagcataaggtaaactttaaaaaaaatttgtattagcagaggagtcttcttatacatgtagctctgataaactggctcatgatcttcatgatcttcagtatgttttcgttgctgcataactggataaggtgtgaagggaaaacaaaaacaaacaacctcctgatttggaagacttagctgaacctatctttggaaacagaatcaattaaacatgtatgtg

SEQ ID NO: 18474 - DNA, 300 bp, Homo sapiens
agcccaaacttagaagcaaccatgatgtccttcagtaggtgaataaatgaataagccatcgtacatccagaccgtggaatattattcagtgctaaaaagaaatgagctatcaagccaggaaaagacatggaataagcttaaatgcatattactaagttaaggaagccaatctgaaaaggctacataggccagtcacagtggctcatgcctgcaatcttagcactttgggaggcaaaggtgggaggatcttttgaatccagtagttcgagatcagcctgggcaatgtggtgaaaccctttc

SEQ ID NO: 18475 - DNA, 329 bp, Homo sapiens
gagatgatgaaacggaataatgaaatggaaatgatgagatgagatgcaatgagttgaaatgagatgaaatgatgaaatgatgagatgaaatgatgagatgtgatgaaatgatgacatgaaatgatgacataaaatgagatgaaatgagatgtaatgatgaaatgagatgagatgaaatgagatgaaatgatgagatgagataaaatgatgatatgaaatgagatgagtgatgagatgaaatgatgagatgatgagatgaaatgatgagatgaactgatgagatgaaatgaaatgaaataatgaaattgaaataaaattgaaatgagatg

SEQ ID NO: 18476 - DNA, 192 bp, Homo sapiens
acgacatgcactggtcatttcacttctaacttgggataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgttt

SEQ ID NO: 18477 - DNA, 322 bp, Homo sapiens
aacatgccttcctcactaagcttaattgtttctagcttttgatttaaagtgaatgatgtgtgacgcttcctttcacttgaacacttagaggccattgtagagttcttaactggccccatttcaatagtgttgtgtctcagggagtaaggaggcctgcacagagggagagagatggaggagtggacagtcggtggagcagcagaacacacaatatttatcgattaaattcaccatcttatttgagtgtgtttacggcacccccaaaaaatccaatagtagcatcaaaaagtatagatcacagatcacgataacagacagaaag

SEQ ID NO: 18478 - DNA, 299 bp, Homo sapiens
atcttagtctcagatgcagagagagcagcggccatcccttctccagatgcacaagtagtgttgtatgcactgcagaaacagtaaacacaacctcttttttctatagctgacatcgtgaaatgatgaagatttgggatagaaggtactcgagtgcacttaaagctccccagaggataaataactgattcatgaacacatttgataagagagtgcatggagctataagttaaatccggggggggaaactataaagggtaatccccacagtattgtaatatggattgtaggagggattatac

SEQ ID NO: 18479 - DNA, 263 bp, Homo sapiens
agtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgcttccaggagactagactactgttgtccaggg

SEQ ID NO: 18480 - DNA, 140 bp, Homo sapiens
ttttgaagctgcttcttcgaatttgcaattcaatatgaaaatcacctcggagctggtaaaaagaggcctaacccctgtctttagatttacagtccaatgcttcactcagccattttacctcacccccgaaaaaaaaaaaa

SEQ ID NO: 18481 - DNA, 220 bp, Homo sapiens
ctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctaggtgaaaataaagtgtatattttttctataaaaaaattaagcaaaaaaaaaaaaaaa

SEQ ID NO: 18482 - DNA, 292 bp, Homo sapiens
aattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagagggaaataaagtactttt

SEQ ID NO: 18483 - DNA, 300 bp, Homo sapiens
  misc_feature 95: n = A,T,C or G
aaattgaaacctggcgcaatagatatagtaccgcaagggaaagatgaaaaattataaccaagcataatatagcaaggactaacccctataccttntgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatt

SEQ ID NO: 18484 - DNA, 107 bp, Homo sapiens
cataccattgtcactgtattactgctcatgtcattgcactggttcatcttccttctcaacttacctgttgccacttggaatatatatcgatacattatggtgccgag

SEQ ID NO: 18485 - DNA, 330 bp, Homo sapiens
tagagcggaaagacacaaaaagagaacactggttcagacattcagtgggcaagtaaattatggactgcaaaataatgatttttattcaagaaagctttaaaagttttatatccagatatacaaccacaataaagcagaataacctactatcaaaatagaaatgttgctatctttataagtgcaatttaatttgtaaataggagtttgaatcaaagtatcacaaaatactgcttcaagatttaattttaaatctgctaatttaagggatattgggaaaggtttgggggggctctggtggattccttttttggatgcctgggataaaagaga

SEQ ID NO: 18486 - DNA, 295 bp, Homo sapiens
gatcttgtattctgctaccttgctgaattcatttatttattagttctaatagttctttagtggattcctatggatttttttatatgcaagattatgtcatatgcaaataccaattatttttcttaagccaggagtggtggctcacgcctgtaatcctagaactttgggaggctgaggcgggtggatcacctgaggtcagaagttcaagaccagcctggtcaatatggtgaaaccctgcctgtactaaaaatacaaaaattacttgggcatggtggcacatgcttgtaatctcagt

SEQ ID NO: 18487 - DNA, 334 bp, Homo sapiens
gaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctcttcccttacggaattacatcttgatggcaacaaaatcagcagagttgatgcagctagcctgaaaggactgaataatttggctaagt

SEQ ID NO: 18488 - DNA, 308 bp, Homo sapiens
  misc_feature 15, 37: n = A,T,C or G
taggaatagcactgntataaacatagtggctggcagnagcttgagagatttgtaatgttacttgtaaacagaccgtgtggggaagaccgcagacagcacatcattttttgtctttattggactttatgactaacacttcatctctgcatcacttctgctttgctgtaaaacttagcaagtacattaggatagtggcaaataaagattaagattgaggacagatgtttgtaaaataactgggcgattttaagattacaggtgtaacttgttaagaagaagataactggtgtggaaataaaatctgcagc

SEQ ID NO: 18489 - DNA, 303 bp, Homo sapiens
  misc_feature 66, 176: n = A,T,C or G
cctcctcatcttttcttcttacacagtgtctgagaacatttacattatagataagtagtacatggnggataacttctacttttaggaggctactctcttctgacagtcctagactggcttctacactaagacaccatgaaggagtatgtgctcctattattcctggctttgagctntgcaaacccttctttagcccttcacacatcgcactgaagaatatgatgctgaaggatatggaagacacagatgatgatgatgatgatgatgatgatgatgatgatgatgatgatgaggacaactctc

SEQ ID NO: 18490 - DNA, 153 bp, Homo sapiens
  misc_feature 18, 146: n = A,T,C or G
accttggtagcttggggnagaaaggaaaggccacttctcacttgcaggttgaaactgagtgaacgagcctgagacactagaggggcccttctttgcccaacatctccaaaaacatttgcttccaagacacatgaaggacagatgtnattctgc

SEQ ID NO: 18491 - DNA, 128 bp, Homo sapiens
  misc_feature 110: n = A,T,C or G
ataacatagtgtgaatgtttgtggccaattcaattgtggaatcttatggctttgtttttactttgggtagaagtttaacttccattgttcagattttaggtttatctagngaaattgtgccaggtagt

SEQ ID NO: 18492 - DNA, 300 bp, Homo sapiens
gccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgcttcctgtcctgcatcgcatgatgtgtaacgaattctttgaaggcttcccagataagcagccaggaagaaatgaaaac

SEQ ID NO: 18493 - DNA, 340 bp, Homo sapiens
  misc_feature 271, 286, 319: n = A,T,C or G
ctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggccagtgttctgatttgggctggacaaagtgccaaaggatcttccccctgacacaactctgctagacctgcaaaacaacaaattaaccgaaatcaaagatggcgactttaagaacctgangaaccttcacgcatngatcttgtcaacaataaaataagcaaagttagncctggagcattacacctttgg

SEQ ID NO: 18494 - DNA, 340 bp, Homo sapiens
  misc_feature 185, 273, 284: n = A,T,C or G
ctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggntgagatgaagcttcttcatggagtaaaaatgtatttaaaagaaaattgagagaaaggactacagagccccgaattaataccaatagangggcaatgctnttagattaaaatgagggtgacttaaacagcttaaagtttaggtttaaaaagttgga

SEQ ID NO: 18495 - DNA, 360 bp, Homo sapiens
  misc_feature 288, 340: n = A,T,C or G
tattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttggcaaagatatagttttgttccacaatttgtacttaaaagcgaaagaacattgaaaacatagacttactgctgnagcaatgctgcctgtaactgatactagacttaggtcacgtttatgtaaaggngtaaacctagtagagctgca

SEQ ID NO: 18496 - DNA, 490 bp, Homo sapiens
  misc_feature 51, 82, 85: n = A,T,C or G
gacaactttggtgctttaaaatgaggtaccactttttaaagctagctgtgnctgagtaaaagaaagtgtcagctgtattatntcnatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcagcaaaataaatatcacagtattatctgtgttaaaatggttttgcctaaaatataattttaaattggctttcttattaaaattccattatctatgataacacttgatcagtttaaaaattagctaagagatcaaggagttatttatcagctttaatgcagattcttctgcatatgtggcttccaacataagagtaatgctcttataatc

SEQ ID NO: 18497 - DNA, 380 bp, Homo sapiens
  misc_feature 164, 194, 205, 220, 223, 280, 294, 305, 333, 373, 374: n = A,T,C or G
gacactgttcaggaatcggaatcctgtcgattagactggacagcttgtggcaagtgaatttgcctgtaacaagccagattttttaaaatttatattgtaaatattgtgtgtgtgtgtgtgtgtatatatatatatatgcacagatatctaagttaatttaaagntgtgtgcgcctttttatttgtgtttttaangctttgatgtnacaatgttagcctcnatntctgaacaccataggtagaatgtaaagcttgctgatcgttcaaagcatgaaatgganacttatatggaaantctgctcaganagaatgacagccgcaaaacagattgttngcaaaggggagccacagtgtccttgcagctgatttctagnnaggaaa

SEQ ID NO: 18498 - DNA, 291 bp, Homo sapiens
  misc_feature 28: n = A,T,C or G
gttaaatttaaaatgagaactgtctggnaataaatcttccaaaaaccacatataaactgaaaaattatgaatacaataatgttttaaagtttgtaaaagaaaaactaaaaaatgggccgggcatggtggctcatgcctgtaatcccagcactttgggaggccgaagcaggtagatcacgaggtcatgagatcgagaccatcctggctaacactgggaggctgaagcaggtggatcacgaggtcatgagatcgagaccatcctggctaacatggtgaaaccccatctctacc

SEQ ID NO: 18499 - DNA, 420 bp, Homo sapiens
  misc_feature 383: n = A,T,C or G
cttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggtcataaaccagaaaaggtcacatggacggaagcagcaggaagcattcgggatggaggcgngcctatacagctctgcataatcttctcaactctctcc

SEQ ID NO: 18500 - DNA, 380 bp, Homo sapiens
  misc_feature 4, 28, 33, 79, 81, 93, 136, 146, 179, 180, 183, 202, 223,286, 304, 319, 335, 343, 344, 360, 361, 372: n = A,T,C or G
ccgntcagtccatttgcggaggaacatnggtgntacagcagtggcatttaataaggaacttgatcctatacagaaactntntgtggacaagancagagaatacaaacctaagcgacagacatctggaggacctgtngatgctagtncagagtatcagcaagagctggagagggagcttnntangctcaagcaaatgtttggnaatgcagacatgaatacattncccaccttcaaatttgaagatcccaaatttgaagcatcggaaaaaccccaggcctgaagaaanaaaggaaattaatctggnatttgcacggatagngacactagtagagagnagacaacnnattcaactgcaatgcnntatctgagcanaatatggg

SEQ ID NO: 18501 - DNA, 530 bp, Homo sapiens
  misc_feature 345, 432, 460, 462, 514: n = A,T,C or G
gcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctccggacaacaaattcttagtctataatattaggagacatcttctgttttgcaaatgtctgtgaatctgagcaacctggcattctgcttactggccagaaagctggcgggtgacatttgtaacattncctctttgagactctgagttcacctagagaagtctaagcataacagcttctttcccagcacgagcctttatagctctctttaagctnaaccactctgtccatccagccaatggangnccttcccctggaccccaattcaagcttatttaggaagccttgaacaccatgntccggctccagctgag

SEQ ID NO: 18502 - DNA, 119 bp, Homo sapiens
  misc_feature 40, 41: n = A,T,C or G
tccattttacagaagcattttaaatgtagtttgaatattnnccacaagatgctgcaatgtgagttatcacttcatttatcttaaagaaagactaaactgggtgtcagttacatctgaca

SEQ ID NO: 18503 - DNA, 440 bp, Homo sapiens
  misc_feature 266: n = A,T,C or G
aggttgcagtgagccgagatcgcgccattgcactccagcctgggcgacagagggagactctgtctccgaaaaacaaacacaaccatactcttaggaagttttaccaaagattttgtaaatatcctgtatttatttcccatgaagtgtattatttcttcaatattaccaatgcaagtgaacacgggctttccttatagtggtcatatctctgcttttgaactagcaaaatcagcatgagtgtgatttttgaatagatagatttctgngaaatgcagcaaatcccatataagaaatcttagcagtagaatatgaaatcaaaattgcaaaaaagcagttatgtctaaatatgcagcccaaagtttttcttaatatctggagatacaggccaggcacagtggctcacgcctgtagtcccagcactttggggaggctgagaaggg

SEQ ID NO: 18504 - DNA, 230 bp, Homo sapiens
  misc_feature 143, 149: n = A,T,C or G
ttttattcattgtggactatctcaataaatatatgttgaagaaataaacaaatgaacaaaatgcatttgtcagtttagttataaagcaattctaagaatgagataaagcaaaatttcaaggggaagtgatcacaaatatctgngtcatncagagtggtgaattatggtcagattgggcagcatggaaatactgataacttgtgtgcctgtagaaatgctgaaaagaaaca

SEQ ID NO: 18505 - DNA, 328 bp, Homo sapiens
  misc_feature 50, 55, 133, 161, 205, 218, 244, 257: n = A,T,C or G
cccatcccgctggacctcatgatgtgcttccgcctcctgcagtccgtggncatcnaggccctactccgccaccggatctgctctgaccgcacttgaaggctggggcccaggcacctgtgccgccattcgtttnctctctctccctttctttctcccagctntgcctcccttatcccaccctcgaggcagggaaaagccatctatncttctgcagcctnaggagcgagacttcaaggactcagtntggtccacccagntgaaagacacccagtgcacacccagactcctggccttctgtgggttccctttgctccagaaacacagatgt

SEQ ID NO: 18506 - DNA, 301 bp, Homo sapiens
  misc_feature 290: n = A,T,C or G
aaccctgagaccattgggaaacagattcccgatgaagaaatgtttgctctttttttttcttctgaatggccttctataaaatagccaagttctgttaaagaaggcgctgatgacagaatcatagtctaagtttaataccttccgtatcatccatcattgtgcaggctcttacaaaagcatgtttctaattctgctttttctttacaatgaatttatgatgcagattatcaaaccataatatatgaaaatctaccattagaagatggctccttattttaaaatgttcctgngtaattaacca

SEQ ID NO: 18507 - DNA, 221 bp, Homo sapiens
  misc_feature 14, 18: n = A,T,C or G
caaatgatgctagnaatngcctagaaggatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 18508 - DNA, 212 bp, Homo sapiens
  misc_feature 11, 109: n = A,T,C or G
gaaactggatnaccatggcaagcagaaggggagtttcggcttcagccccactcacttgcgcctcccgcccagcagtgacaagaaggggtgtgtgagagtgggatggagngttgtctgttcttttctactctggacagtagaatttttttatctattttataccactgagagtcaactggcctaccagaggcccatttatgtcccccagattg

SEQ ID NO: 18509 - DNA, 300 bp, Homo sapiens
  misc_feature 264, 292: n = A,T,C or G
cgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgctcgtgaagagtatcagaagtggctacgaggtgatgtaaggggtctggtctcctcagcctcctcatctgggggagnggaatagtatcctccaggtttttcaatnaaacggat

SEQ ID NO: 18510 - DNA, 300 bp, Homo sapiens
  misc_feature 37, 52, 288: n = A,T,C or G
gttgttttcagcctgctgcttttgctgctgttgcggntaggggaaccgtcgnggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgngcctacaaaaaa

SEQ ID NO: 18511 - DNA, 310 bp, Homo sapiens
cagtgaaattagtggtaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtcaaaataaagagaaaggtaa

SEQ ID NO: 18512 - DNA, 300 bp, Homo sapiens
  misc_feature 21, 32, 223, 289: n = A,T,C or G
gaaagaacctctcaccaggtntccactattanaggtacagggtcgctttttaaaggttggaagggaagactctacaatagaatttagctcgaaagagaaaatgagaagagaataaatggaatttccaccacaaaaaccctggtttgttattgacatattgggagggggaaggaatgattaccctggaaaaatgccatttcacgtgtctcaataaatatcaggntggattttctgagtatatctatttttatctttaaaactttgggactttgaaggcaaatttaaaggncagaaatacag

SEQ ID NO: 18513 - DNA, 306 bp, Homo sapiens
  misc_feature 30, 249, 252, 273, 286: n = A,T,C or G
ctttaacacaaaagactgacccctcagtcnggcctatgcatgaaagagtgccaaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatgggnttnaaaaaaacacagatttttagngttaatattgtgnaaatgtactcaccttaggga

SEQ ID NO: 18514 - DNA, 157 bp, Homo sapiens
  misc_feature 60, 132, 143: n = A,T,C or G
aaggtgactaatttattaagagcttatcctgaaaagtttaaaatgaagactacatgatgnttttcttctattgaactaggagctggaagctaatttttatgctggaaagttcatcctctggaaagaaaatanccctggggganctttattatcttgg

SEQ ID NO: 18515 - DNA, 137 bp, Homo sapiens
  misc_feature 46: n = A,T,C or G
ctggaggctatccagcgtactccaaagattcaggtttactcacgtnatccagcagagaatggaaagtcaaatttcctgaattgctatgtgtctgggtttcatccatccgacattgaagttgacttactgaagaatgg

SEQ ID NO: 18516 - DNA, 154 bp, Homo sapiens
  misc_feature 16: n = A,T,C or G
gataagatgttttctntttgaaagatagagattaatacaactacttaaaaaatatagtcaataggtactaagatattgcttagcgttaagtttttaacgtaattttaatagcttaagattttaagagaaaatatgaagacttagaagagtagca

SEQ ID NO: 18517 - DNA, 141 bp, Homo sapiens
  misc_feature 55, 63: n = A,T,C or G
gaattgcagtcgcctggcaagaaaaaacaaggataaaggcgaagggaaagaggcngccaaagngaaaagaaaaaaataagaaaaaaaaagagaggatggaaggcagcatagcatagggagaactaactaggagcggaaaat

SEQ ID NO: 18518 - DNA, 117 bp, Homo sapiens
agaggtcgtacaagcaagaccgtgggagtttagtagaggactgctcagaaaggagggcaggcattgcctgttctgcttcgaagtattcaataccgctcagtattttaaaagaaggga

SEQ ID NO: 18519 - DNA, 145 bp, Homo sapiens
  misc_feature 92: n = A,T,C or G
aaaaccaattcccttggggggccccccgggcccctttaaccggaaaacccccgggggaaaaaccggggggggaaaaaacccccaaaaaaggncccgggtttttttaaaaaaattggggaaaaaaaggaaaaccaaaaaatttccc

SEQ ID NO: 18520 - DNA, 179 bp, Homo sapiens
  misc_feature 20, 22, 80, 136, 152, 157, 160: n = A,T,C or G
tttctgttgatgttaactgntntactagagatattcttatttcactaaatgtaaaatttgggagtaaaatatatatgtcnaatattttaggtaaaaggctttttcttttttttaaattttcccagggaaaaaaaantaaaaaaaggaggtantggangtncttttcttggtaaaatttc

SEQ ID NO: 18521 - DNA, 118 bp, Homo sapiens
cggaatgaagttgtgaaaacgtatggaagatcgagcgtatctatagtagattgatgcaaggtagaggatagggattttaggggattttggtttcaagaggggagatatgcttatatga

SEQ ID NO: 18522 - DNA, 198 bp, Homo sapiens
gaaagaagcgcgttcgagcacataatctcttctgattttggagaaaattacccagggagggtgagcatggaagaagcatcctctgccaagaccaaaaggaaagaagaaaaagggccaaaagccaaaatgaaactgatgggacttgttttcaccattgggctaactttgctgctaggagttcaagccatgcctgcaaat

SEQ ID NO: 18523 - DNA, 139 bp, Homo sapiens
  misc_feature 114, 117: n = A,T,C or G
tcgagagagtctgatgtaaagcagacaggggcgagagggaggagaagaatattgcttaattatagaacttcccttgaaaaaatatatcccttccttctattgcaaaaaaccccnttnggggcctctctctagaaaagag

SEQ ID NO: 18524 - DNA, 147 bp, Homo sapiens
aggccataaaacatgactcagtaaatttttaaaaataaaaattatatgaaatatcggctcaaaaaacaaaacaaaaaaacaaaccttttgaaatgaatgtaattggagacacaacatatcaaaacctgtagataccataaaggcagt

SEQ ID NO: 18525 - DNA, 218 bp, Homo sapiens
ccttttgtctttccgtggagctgtcagccatgaaggtcgagctgtgcagttatagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacag

SEQ ID NO: 18526 - DNA, 283 bp, Homo sapiens
  misc_feature 3, 4, 5, 6, 7, 8, 10, 12, 13, 20, 21, 22, 23, 24, 25, 27,31, 35, 40, 49, 54, 55, 60, 73, 76, 86, 88, 89, 91, 93,95, 100, 108, 109, 121, 125, 126, 128, 141, 143, 148, 150,151, 152, 158, 161, 167, 169, 171, 172, 174, 176, 177, 178: n = A,T,C or G
  misc_feature 179, 183, 190, 192, 194, 195, 197, 198, 210, 212, 216, 218,230, 231, 232, 235, 238, 241, 242, 246, 253, 263, 273, 280: n = A,T,C or G
ggnnnnnngngnngggaggnnnnnntntgancctnatggnagaccccgngtttnntgggnaaggcccccgganaanagaaagaggngnnananangaagnatgagganntgtaaaagcgangggnngnaaaggggaaaagngnaggangnnnaagaanggngaaagntntnnangnnnntatnggaaganantnngnnaaacaaaagaangnagangngcgaaagagggnnnaanagnagnnaagnggagaanatgcctatgnaactgaaggnaaccagngag

SEQ ID NO: 18527 - DNA, 112 bp, Homo sapiens
tgttacagtttatggaggaaaaggttcatttagagacgggcaggagctggatatggtctatagcagggatttgctgaacatggaatcgtggcaactctgagagcaacttgga

SEQ ID NO: 18528 - DNA, 168 bp, Homo sapiens
gagtccggaggcgacgagttatgctttttgatacagcatggtgggcctactggagacaggctggactcagctacatccgatactcagagatgtgtgcaaaagcagtgagagatgcactgaagacagaattcaaagcaaatgctgagaagacttctggcagcaacgtaa

SEQ ID NO: 18529 - DNA, 145 bp, Homo sapiens
  misc_feature 3, 4, 5, 6, 7, 8, 11, 12, 15, 20, 21, 31, 33, 41, 42, 55,60, 62, 67, 76, 77, 79, 88, 89, 96, 98, 103, 104, 114, 121,126, 127, 131, 133, 136: n = A,T,C or G
ggnnnnnnggnnggnggggnntatgaacctnangaagcccnngtaaatgggaaanccccnanaaggngaggatagnntnagaaaaagnnggggatntntaggnngaagaaaagnaacaganggaanngggnanggnggaaaagag

SEQ ID NO: 18530 - DNA, 185 bp, Homo sapiens
ttgggcttttttagtggctggtagaaaaacagaattaacaaagacagtaatgtgaagagtgcattacactattcttattctttagtaacttgggtagtactgtaatatttttaatcatcttaaagtatgatgtgatataatcttattgaaattaccttatcatgtcttagagcccgtctttatgt

SEQ ID NO: 18531 - DNA, 204 bp, Homo sapiens
atataaacacaaaatattcaaataaacatttgagaaatgagaaggggggagggcaactgaccccacagaaatataaccatcggaggatattatgaatacttccgtgcacataaactagaacatctagaagcaatggataaattcctcaacacagctaccctcccaagagtgaaccaggaagaaactggatctctaaacagacaa

SEQ ID NO: 18532 - DNA, 156 bp, Homo sapiens
  misc_feature 46, 50, 123: n = A,T,C or G
aggcaggcacgcagataactaagatattgtttcatggccttgcctnaganagaggcccttttctctgtcctgaacccccaggtatgggtgaaattggaaattactaatctattggaaatcagntcctgacatagtaaagtttgctttcataactgc

SEQ ID NO: 18533 - DNA, 138 bp, Homo sapiens
agacatttgggggtaaataagcttttcatgaactatttattagaaggacaggatgtgttgatgaaagagtatttggctgaatgtttgctatatatatggtacttgaaatgttaaatttaatatgcagcataccatagg

SEQ ID NO: 18534 - DNA, 174 bp, Homo sapiens
  misc_feature 67, 89, 100: n = A,T,C or G
tagagttgattggccctatcgggacgacttgcagtgtgttgtcaaaataatactgcacaaaatctgnatacttataggaagataaaaangaacaagtatngggtgtgagtaacttctatcgggaacttacttctaataggtattatccagctagctctagaagataaatatggg

SEQ ID NO: 18535 - DNA, 207 bp, Homo sapiens
  misc_feature 30, 71, 87, 98: n = A,T,C or G
attaaaggtattcagaaacgtgaagccagntattgtttcgcaattcggcattttgaaaacaaatttgccgnggaaactttaatttgntcttgaacagncaagaaaaacattattgaggaaaattaatatcacagcataaccccaccctttacattttgtgcagtgattattttttaaagtcttctttcatgtaagtagcaaacaggg

SEQ ID NO: 18536 - DNA, 112 bp, Homo sapiens
aataggaaaagcagcgggagtacgcagaaacctgagggtggggagagagataggcaaggggagcgtggagggacagaaagaaaaatggagaatagtgaaaggagagccagag

SEQ ID NO: 18537 - DNA, 190 bp, Homo sapiens
  misc_feature 152, 161: n = A,T,C or G
aattgctcaagagttgagaaaactagggagaggaaaaagccaagaagtttgcatttcatgctatcagaaacaggattttcttcccaaatcaaaataaaagaaatatgatcagagcttgaacacaggcttatttataaaataaaaatattttnaacatgggnttccttattgaaaaaacaggggattagac

SEQ ID NO: 18538 - DNA, 153 bp, Homo sapiens
tttaaaaaaaacaatgtttgtaacaagggtgccatggtatttttagataactcgtgattatcttaagagaggtaaatttagtgatcattttatatcatggcttattccttcttaatgaacataatttggtaaattctcaagcaaggttttcac

SEQ ID NO: 18539 - DNA, 123 bp, Homo sapiens
ggagagagagggcatgaccaaaagtgcaagtaggaaaggacacagacagcgcgggcagcacggaagagaaagggacggaagaccggagggacaagcacgaagaatgtactgagatatgggaaa

SEQ ID NO: 18540 - DNA, 143 bp, Homo sapiens
gaccaactgactgaagagcagagtgcagaaccaaagaagctttttcactatttgacaaagatggtgatggaactataacaacaaaggaattgggaactgtaatgagatctcttgggcagaatcccacagaagcagagttacag

SEQ ID NO: 18541 - DNA, 125 bp, Homo sapiens
  misc_feature 112: n = A,T,C or G
acattttctggtggatgaggaaccacctggtgaatgctgcacagtgagagagggatgttattataaatcgaaaactcaaggcaccataccaataaacatgaataaaaactgnaggaagatgaatg

SEQ ID NO: 18542 - DNA, 106 bp, Homo sapiens
tgaatagaagcaagaaaaaaaaataggttaaggtaaagtagtcgaacaggagatgagcagagctgacaagaacaagctgaaagctggatacctaatgtcaggggag

SEQ ID NO: 18543 - DNA, 118 bp, Homo sapiens
acctaagggccatgtgactgggaggagccgaaatggaaaagtgtaccaatggtgcctcccggaatcaagtatctttaccttaggaataaccagattgaccatattgatgaaaaggcct

SEQ ID NO: 18544 - DNA, 175 bp, Homo sapiens
aagtgccatgtgctgtgatgagctgaaatggaaaagtgtaccaatggtgcctcccggaatcaagtatctttaccttaggaataaccagattgaccatattgatgaaaaggcctttgagaatgtaactgatctgcagtggctcattctagatcacaaccttctagaaaactccaag

SEQ ID NO: 18545 - DNA, 133 bp, Homo sapiens
ggaggctatccagcgtactccaaagattcaggtttactcacgtcatccagcagagaatggaaagtcaaatttcctgaattgctatgtgtctgggtttcatccatccgacattgaaggtgacttactgaagaat

SEQ ID NO: 18546 - DNA, 147 bp, Homo sapiens
acggttgattactgacatgaattttaaaagccgagggaaatgaggcgcaaacagggatttttgttaaagaaaagatgaaaggcaggcctatttcatcacaagaacacacacatatacacgaagagacatcaaactcaatgcttgatt

SEQ ID NO: 18547 - DNA, 178 bp, Homo sapiens
aaagctaagggggcaagagaatgtggaaaaaccttctctcaaaaatcaattctcagtgcacatcagagaacacatacaggagagaagccttgtaagtgcactgaatgtgggaaagccttttgttggaagtcacagctcattatgcatcagagaactgatgtagatgacaaacattgat

SEQ ID NO: 18548 - DNA, 130 bp, Homo sapiens
gtgagggaatgcagaagggagagttaagagaggtatgcaatgaagaaggtaaagtaagttgttatttaagttttaaatgtaccttcagaataagcttcccgacccgaggttttgttgcttgaagatattg

SEQ ID NO: 18549 - DNA, 107 bp, Homo sapiens
  misc_feature 49, 63: n = A,T,C or G
aagcaaaacaattgacccaaaaaaagtataggagattttaaatggaaanctggggcaataganataggccgcaaggaaagatgaaaaattataaccaaaaaaaaaaa

SEQ ID NO: 18550 - DNA, 124 bp, Homo sapiens
tgtgcaatgagctgaagaaccctgtctccaagtctttggttgaagagaagatatatgactgttgagtgtgctctttcacagaacttggttttcaaataaatataagatctccagatggaaaaaa

SEQ ID NO: 18551 - DNA, 103 bp, Homo sapiens
aggaaaagtgggaagcgcatgcacaacgtcgtccggctgtacagtcgacgcgggtgcagggggacggaatgccgtgggttgtcggggcacagcttgtcctgag

SEQ ID NO: 18552 - DNA, 148 bp, Homo sapiens
tcaaaaagaggacgactgccaaagcgtgcgagggttcagagccgacagggcagaggcgagcgaggcggaggcaggaggatagcttgagccaaggagctcgagaccggcctgggcaatatagcaagaccccattctcagaaaaaaaaaa

SEQ ID NO: 18553 - DNA, 145 bp, Homo sapiens
aaattatccagtgtatggagaaacgacacaggttaggagacgcgctgagaacgtgctataggaccttctgaaacacacaccatcagaattcaatattcacctgccagactggcttatcaagacaaaggtgtccttcataatgaag

SEQ ID NO: 18554 - DNA, 176 bp, Homo sapiens
ataaaagggtgctaaaacatgacggaggtggagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaa

SEQ ID NO: 18555 - DNA, 340 bp, Homo sapiens
caaatgatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgccatctacttgcttaaattgtgggcaaaagagaaaaagaagggtttgacagagcattgtgcaatacagttcattaactccttccccgtcccccaa

SEQ ID NO: 18556 - DNA, 350 bp, Homo sapiens
acagcaacgctgcggtcagggtatctttgaccagacacttaagcatatggagatagaatagaaagaaggcttcggctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggcatgtgaaatttacatcatttctttttgggagagcttgtttgggatgcccctaatccc

SEQ ID NO: 18557 - DNA, 380 bp, Homo sapiens
gcgggtgggccggactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggaattgaaactgtgggaggggcatgaccaaactgattccaaggacacagtggtgcctaccaagaaggctcagatcttttctacagcttctgataatcaaccaactggtacaatcaaggctatgaaaggggaaagaccctgacaaaagacaaacatctctgggacatttgatctgctggaatcctcctgc

SEQ ID NO: 18558 - DNA, 470 bp, Homo sapiens
atttagcttgatagagggtatatttatagggagaggcgacggaacctaccgagcctggtgatagctggttgtccaagatagaatcttagctcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcggtcaagctcaacacccactacctaaaaaatcccaaacatatactgacctcctcatacccaattggccaatctatcaccctatagaagactaatggtagtataagtaacatgaaaacattctcctccgcataagcctgcgtcaagattaaaacactgactggcaattaacaggccaatatttacaatcaaccaacaagtcattattacccttactggcg

SEQ ID NO: 18559 - DNA, 201 bp, Homo sapiens
  misc_feature 128: n = A,T,C or G
ctgggtgactatggaagccggagtgtctaattgcagataatgagtagctcagggcgtggtggctaggtcgggttctctcctttccagtcggagacctctgctgcaaacatgctccgcagatcatcggncaggccaagaagcatccgagcttgatccccctctttgtatttattggaactggagctactggagcaacactga

SEQ ID NO: 18560 - DNA, 176 bp, Homo sapiens
agaatcgacggcaactgagactggagaacagtctcggagtatctatcaaaactacgtatgcaccttaccctgggacccagcaattctacttgtagggaggggtcccacagatacactcacttctatgacattatgtctaaacagatttattgcaggcttgtatatgggactgaaag

SEQ ID NO: 18561 - DNA, 132 bp, Homo sapiens
aaaaagatgaggggaaaagcaaaaaaaaaaggaaaggagttgaggaggaggggacaacaactagaaaatggggtcgttggaggcgagaggaaggggagaagttggagaatagtgttagctgagggggtagag

SEQ ID NO: 18562 - DNA, 209 bp, Homo sapiens
aacagagtaaacagacaacttacaggatgggagaacatttgttgcaaactatgcatctgacaaaggcctaatatttagcatttataggaacttaaaaaaatttacaagagaaaaacaactccattaaaaagtgggcaaagcacgtgaacagacacttttcaaaagaagacatatatgtggccaaaaaacatacagaagaaaagctcagt

SEQ ID NO: 18563 - DNA, 195 bp, Homo sapiens
gaacattcgacgggcacctgaagaaaatcggatattgtatataagaaatgggccatacaaaatcacaggtgaagaaatgtatgatatatgtgggaaatatgggcctattcgtcaaatcagagtggggaacacacctgaaactagaggaacagctgatgtggtctatgaggacatcttggatgccaagaatgcatg

SEQ ID NO: 18564 - DNA, 165 bp, Homo sapiens
  misc_feature 32, 40, 41, 59, 63, 141: n = A,T,C or G
catgaaagaggatgatcacaagtggggaaggntgaaattnnaaaagaactgactgaagnaacncctctactaatgtgacaccatctctatcccccacaaacccttggaaatactagttttgggagaagagaggagtatggngactagaaagtagctataacctgg

SEQ ID NO: 18565 - DNA, 197 bp, Homo sapiens
  misc_feature 111, 148, 159, 160: n = A,T,C or G
agaagcgagaaagaaggggcactcactgtcaatttttgcaatcgtttttacagatgttaaaagacctggctatcgagttaaggagattgggcagcaccatgtcttggcagnaaagggggactggatggattccatggacccttgcagncgcaaggaagnntcccaggatagggaagaatataactttgggtacaata

SEQ ID NO: 18566 - DNA, 167 bp, Homo sapiens
ggggaaagatggggagagaagtgagattatgtgataaatatacaaaaaaaatccagcataataatgaaatataaggtccagtggggaaaaaaacaaaggcatgaataggaaattcacaaataaaagctataatacatggttaatacgtgtgtgaaaaactactcaat

SEQ ID NO: 18567 - DNA, 127 bp, Homo sapiens
aaaagagacaagcaggaagcacagcaaaaatgcagctgaaaacggttagcctagccacacccccacgggaaacagcagggattaacctttagcaataaacgaaagtttaagtaagctatactaaccc

SEQ ID NO: 18568 - DNA, 104 bp, Homo sapiens
agaatgtgagacagagattagtagagattagagtgaaatgggaagagggaaagggaaagggccaaataagtggtctaaacactatggaaagagaggtagttcaa

SEQ ID NO: 18569 - DNA, 216 bp, Homo sapiens
agaaataaagatgttgtttgaaaccaatgaaaacaattatacaacataccgagaatgtgtgggacacatttaaggcagtgtgtagagggaaacttatagcactaaatgcccacaagagaaaggaggaaagatctaaaattgacactctaacatcacaattaaaagaactagagaagcaagagcaaacacattcaaaagctagcagaaggccaaaaa

SEQ ID NO: 18570 - DNA, 176 bp, Homo sapiens
  misc_feature 143: n = A,T,C or G
aaggttgaagggaaaaatgcgaatacgaggatgcaaaatgtatactagcatatatgaaatagaggggaaaactgccagaagtcaaagggttaggttgattaagcactacagaatttaatgtatacacacacacgcaatttagngattttaattaattggttcaaaacaaaggtatt

SEQ ID NO: 18571 - DNA, 144 bp, Homo sapiens
gatggggaaggaagaaataagtttatagttgataggaaaggagatggataaatatggatttttgagataaggtctaagctctggatatttagaaagagatgggggttacaccatatagggcaagggtgggctggaacttattgg

SEQ ID NO: 18572 - DNA, 178 bp, Homo sapiens
gggaagatagatggggtggttttgaggggagtggtaagaggagactgagagggatgtttgaaaaaatcgagatggctgagatagagaaattcgataagtcgaaagtgaagaagacagagacgcaagagaaaaatccaatggcttccaaagaaacgaatgaacaggagaagaaagcagg

SEQ ID NO: 18573 - DNA, 129 bp, Homo sapiens
gcctggtaggagatgaaagagacttgacatgttaaaaagaagtaaaaacaggaaagtggcctttgtagcgggtgtacatatctaataagatacctctttactttctaggaaaaaggaattgaatagatg

SEQ ID NO: 18574 - DNA, 132 bp, Homo sapiens
cccagattagaaaaaagaaattaaaaaaaagaaatttaattttgggatctgggcgtttctataggctcttcaaataatttcatgagcctggtgattgtgtttctcagatacgtggttaagctatacattgag

SEQ ID NO: 18575 - DNA, 112 bp, Homo sapiens
ggagatttgatgaggaagtggttaggatgcagggagatttactatgggagagatttgacttgtttaggaggtgtgagttaaaattgtatcctttctggttatctaagggaag

SEQ ID NO: 18576 - DNA, 174 bp, Homo sapiens
aaaaatatggaccagatctatgcgagaaggattataaaactctgatctaataaagaagatctaaataaatggagagatactgcatgttcacagattggaagactcaatattggtaagatgcctgttcttcccaacttaacctatagattcaatccaattcaagtaaaatcccag

SEQ ID NO: 18577 - DNA, 332 bp, Homo sapiens
gttccctccagtcgcagaccctatcagatttggatatgtccttcatatttgattggatttacagtggtttcagcagtgtgctacagtttttaggattatataagaaaactggtaaactggcatttcttggattggataatgcaggaaaaacaacattgctacacatgctaaaagatgacagacttggacaacatgtcccaacattacatcccacttccgaagaactgaccattgctggcatgacgtttacaactttttgatctgggtggacatgttcaagctcgaagagtgtggaaaaactaccttcctgctatcaatggcattgaatttct

SEQ ID NO: 18578 - DNA, 171 bp, Homo sapiens
aaattcaaaaaactcctggtgccaggaaaaattcagcacattctctgcacaggaaacctttgcaccaaagagagttatgactatctcaagactctggctggtgatgtcatattgtgagaggagacttcgatgagaatctgaattatccagaacagaaagttgtgactgttg

SEQ ID NO: 18579 - DNA, 161 bp, Homo sapiens
aagattctattttcagttgtgtgtaagcaagttttttttagtgtaggagaaatacttttccattgtttaactgcaaaacaagatgttaaggtatgcttcaaaaattttgtaaattgtttattttaaacttatctgtttgtaaattgtaactgattaagaat

SEQ ID NO: 18580 - DNA, 336 bp, Homo sapiens
tcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgtactgtgatattttaaatatccacagtactcactttttccaaatgatcctagtaattgcctagaaatatc

SEQ ID NO: 18581 - DNA, 284 bp, Homo sapiens
tccagtaaggaacacagccacatgtgagaggagactgggaaaaagaaagcaccacaaaattgaagaggctaatttggggattgccagctctattcttcaaataaaattagttctgtgttctttggttactttttgacattttctgtacatcaactgctactttaaactgcagcaaatctctcattcagagctcacaggagtataccatttttttttctctctaagccagataagtttggtcttttctttaaagcaatagagctgaataaaataaaataataata

SEQ ID NO: 18582 - DNA, 324 bp, Homo sapiens
tttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgcttaaacagcttaaagtttagtt

SEQ ID NO: 18583 - DNA, 349 bp, Homo sapiens
tcctgtctagagattatgagatgttaaggatcatggagcatggggctgaaaaatagcttctgttgaaactgaatgaaaatccagtagagaccaggcgtggtggctcacatctgtaatcccagcactttgggaggccaaggcgagtggatcacctgatgtcaggagttcaagaccagcctgcaaacatggtgaaaccccatctctacaaaaaatacaaaaattagccaggcatgatggcaggtgctgtaatgccggctacttgggaggccaaggtgggagaatctcttaaactaggcaggcgggcagaggttgcagcgagccaagatcacaccattgcactccagcctgg

SEQ ID NO: 18584 - DNA, 310 bp, Homo sapiens
aattgttttctcacttaccttctttaaaagaagaatgtggccattagccttcggttctggcatgggattaggaatggcttattccaactgtcagcatgatttccaggctccatatcttctacatggaaaatatgtcaaagagcaggacagtgacttcacctgagaacatcccagcgggaggacaagagaaatcatgtttattcctcaggaatactgaagtgccctggagtaagctgccattcttctgcaacaatgttatcagtaatgctttaaactccagcacctggttatgcatttgaaaccaagtctg

SEQ ID NO: 18585 - DNA, 133 bp, Homo sapiens
agagctctcatctgaggcagcacatgaaggtgcataaagaagagaagcctcgtaaaacccggggcaaaaatatcagggtgaagactcacttaccctcttggaaagctggtacaggaaggaagtctgtggctgg

SEQ ID NO: 18586 - DNA, 249 bp, Homo sapiens
attcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctcc

SEQ ID NO: 18587 - DNA, 132 bp, Homo sapiens
ggggggcataactgtgttgggagcagttcctaagggcagagttgttcacagttcacatagcaggtgtcacactggggagcaggtggcatattagatgattgttcaggcacttccaatcctgagatcccatgg

SEQ ID NO: 18588 - DNA, 219 bp, Homo sapiens
gtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgg

SEQ ID NO: 18589 - DNA, 317 bp, Homo sapiens
  misc_feature 19, 22, 39, 58, 70, 85, 127, 217: n = A,T,C or G
gaagagtgataaggaaatngtnggactcttctaggattngatgactttgcaatatggnactggaagatgncactgagtttgaaancacaccagaaggaagaaggattactaaattagatcagatttngctaaatggaaataatataacaatgctggttcctggaggagaaggacctgaagtgtgaatgagtttccttgacttacactagattttgtnttggcttataatgacaagaaaatggaatttttttttcccactttctaatgtttaaatcccataaagctaagttcccgttaaagggaagtgctttgaagat

SEQ ID NO: 18590 - DNA, 502 bp, Homo sapiens
  misc_feature 471: n = A,T,C or G
gacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacaggntgtaagcctttcaacagcgcatcaacctacg

SEQ ID NO: 18591 - DNA, 203 bp, Homo sapiens
tcctgctcgggtcacaagcgccagaagcgccggcggctggcggggaaacgataaaactctgcaaagacaatgtctagcacttatatctccagtaactcctgtcaaggtttattgttgcttgttcatcattgcagtcctgactacaagtgtgattgcactttctattgttttgtcagaatttcctgaaaagatacaaaggccct
